United States Patent 10,407,724 (METHODS AND COMPOSITIONS FOR SCREENING AND TREATING DEVELOPMENTAL DISORDERS) - sequence listing, part 15

SEQ ID NO: 263 - DNA, 1976323 bp, Homo sapiens
aatagaaaaggagttaagacattctgcaatcattgaatttcctggtaaatgataaaggcatatgaaaatatgttgaaatcgaagtataatttaaggcaaaaaattattagatatagatacacttaatattcataaaatattaatccagcaggaaaatgtaacctttttatatgaatgcgtacataatggagtctcaatatataaagcaggaaattgacaggattcaaagacataaaaatcatgatgaaaaataacatctctcctagtaactgatgcaacaagtaagcatataatcagtaagtgtagagaagttttgaattaaaaattaacaaacatgctctaattgtcattattatatagaacatctcatttaataccttcagagaatttcttattttctggggaatctactacattttacaaactgattatattctgggccataatgcatgtctcaaaaattttaagtgatggaaatcaagctatgttctctgaccagcatagaattaagaaaaaaagttaacataaacaattctaaaacaaaccaaaacagaaaaatctcatgtgtttttcagattaaccaatttgattctgaataacctgaggataatggaaaaaaagatttgaataaaattatattcaattttgagctaatgataatgaaactattgacaaaattataaactatatagacatccgtgatttgagagaaacttatcatttaaatgcaaatatattttatacattttattttattttactttttgagacagagtctctctctgtcgcccaggctggagcacggtgctgagatctcagctcactgcaacctccacctcccaagtttaagtgattctcatgcctcagcctcccaagtagctgggattccaggcatgtgccaccatgcccggctaatttttgcatttacggtaaaaacagagcttcataatgttggcctggctggtctcgaacccctgacctcaagtgatcctcccaccttggcttcccaaagtgctgggattgcaggcatgagccaccatgcctggtctaaaatgcatacatattttaaagttataaaggtatatgatatatgcattcatctctaaaacttattcaacaacagcacattaaaataaactaattgaaatgatgaaataataaagataagttagaaatgaatatagtaggatcaaaggtcaaaaatcagtgtcataaattgattttttgaaaaaagctagggaaattgataaccccctggtaggactgtattaggccattcttgcattgctataaagaaatacctgagactgggcaatttgtaaagaaaagaggtttaattggctcatggttctgcaagttgtacaggaagcatgatgctggcatctgctccacctctggggaatttacaatcatggtggaaggtgaagtgggagccagcacttcacatggccagagtaggaggaaaagaggaggtggtggaggtgctatacatttttaaacaatcagatcgcacaataactcacccactatcatgagaacagcaccaaggagatggtgataaaccattcatgaagtattcacctccatgatccaatcaccacctcccaccaggctccacctccaaaaatggggaatacaattcgacatgagattacaatttgacacaaatccaaaccgtatcaaagaccaataaagaaaaaaaaaatcatgtagcagaaacaaccaatctctggaataggaaagaacattatagtttctataaacatcaaaatgataattaaaaggataatgaaaatttcttgtgaatacatttgaaaatcagatgaaataattttgtgcacaacaatagtatttaaaatctagtatttaaaatctaataactggttctgatacctggtggtgagttgctgccataacaaattcctataatatgtgtcactgttcttggtaccacatgacagtcagaagatggaatagctttgtggaggcatctggaggaagtctagtgagcctgaacaaagatggccatgagaacacagtgcaaaaacaatgttattggagggtggacaaaaggattcccttccagcgtagtcttggaaagattatcacaactgttacaggcagttgcataaaaaacagagactgtgactaaatgaatggatggatctggctaaggagaattccagggagaatgtgtcaacttattttattaaggttacaaggaccataaggtctgaatagaagaaaatcaagtaattaattattttttaagtagaatgcagaggaaatataaaggtgccagaaatttgtgtttttaacaacaaaactattctccatgtcctgttgttccagatggcaaatgactcatgcaaacataaatttgaaggtattacaagcgaaatatggtcttagggtaaaaatgaggcttttgctaagaccttagagagatccaagatgtacctaatggaatcctgaaaacaaataaaaagccttatagagatgttacgggcgtgactctagagttgtaaggacttctaacaatcttaatggcattttccttcagtagcctcattaggatcccaagatagagaggcaccctatatcaagggagttttgtttaatcaactgattctccagtaaaattgatagtagacccataaagacttttttttttttttttttagacggagtcttgctctgtagcccaggctggagtgcagtggtgcaatcttggcttacggcaagttctgcctcctgagttcatgccattctcctgcctcagcctcccgagtacctgggactacaggcactcgctaccatgcctggctaatttttttttttttagtagagacggggtttcactgtgttagccaggattgtctcgatctcctgacctcgtgatctgcccaccttggcctcccaaagtgctgagatgacaggcgtgagccaccgtgcccggccataaagaccttgttgatcattttgctagtggaaacatcaaaagcttgaaataaaagagacagagagtgcaaaatgaaaagagcctctggaccccaaacctttgtgagcaggaagtaggctaaaagaaccaaattatcacttacggaacagaggataattgtgagagggtagaatcagaggacagctcaagaacaacagagagcaaaatcccagagaataagaatgctctttaggaaaatgaatggattattattacagaaactgatatttatctgtctagattttagattatctatggaccaaagataactagattcctcctacctcaccctctttttgaatggaaacttctactgcagcttctgtatttccacttcccaccattatatgttgagcatggaagacatgtaatttggtcctttatttcacagatctactgatagaaactggacaagaactatgcctgaggaacctcaactaaacctggacctgatttagatgaagagatcctggacctcaaaattgaattttgtgccataatgggctgaggtcttttggaggtttttagatggagtgagcataatttggatgtggaacgaatagaaataacttgtggtcagaaggtgaaaggttaaaaaaaatggctgcaaaaattcaagtaaaaatttttaaaaaattgaaagaaagttgggttacagattccctcaccttgaatctgagtgagtttgtgattatatttttacaatatggtagaaatgatgctatgtaacatctgaggtgacacgtaaataagaaagacaaaaatatgcagtgttcatattgttcactggaacaccaaatgagatgtgtgactaccaggaggccatcatgctgtgagtaagcccaagacaaatggaaaggcaatgagcagaccatttggtctatggtctcagctgactccagcctttgcatctccccagctaagacactaaatatgtttgtgaaggaggttccagatgattccaactctcatctgtcaagttgaaaccaatttcacaaaacttctatactaagatttaatattttgaattttaagtaactgtttacctttaaaaaaattctaataaaattttgcccccatatgaaatgaatgtatttttatctatacaaactggcttcttcccttaggataatggcctcaggaagagaaacccatataccatgtgttctcccttataagtgggagctaaacatggagtacatatgacacagaagggaacaatagacactggcccacttgaggtgggaggcttggcagaaagtgaagatcatcaaattacctatcaggttctatgctcactgcctgggtgaaaaaataatttgtacacagaatgccagcaacacataatttacccatgtaacaaacctgcacatgtacctcttgaacctgaaaaataaaagttggtagggaaaaaaataacataacaaacctaatttaacataacataacataaaacataacatataacatagacataacataaaaaacaatataacaacataacataataacaacataacacaacgttttaaaaaagaaactggcatctatctagttgtgcttataaattttcttttatttttatttattttggctaaaactgtttaacaattttgaatggccatcttatttttgaacagtagattgagtcctagacttttctattgcttcttatattgtaaagaatctgaaatagtttttgagacaaagcagctccaagaaaacctgtctctggcctacatttttatcccacttcatggaaagataaggtaatcccaagaaaaagcagatatacaccattcgggcccaataaatagtcttaaacatatctagcccaaatttcagatttatcataatggatttgacgagaaagaaggagctagtacaaagtcgacacatacttcctttgtaccacattccttgtcatttatatgtgtctgattccattcctgttaatgataagcagctaactatgatagtctacgagcgcaggatctttaccttattaaatgctgtattctcagagactaagtgcgcagcgcatggtttattgatgaatactcaaaacatttatttatatttgaatataattccatcatgactcgtaaacattttttacgtaatatttttcaacaatttttacataaataatacttggcaagtattttaatattttttacataaataatacttggcaagtcactttaatgcttctgtgtcatttccttatttgaaaccaaaaaaagtgttcaacatttacctaagtttctttttagttttcatatgtaattattcggagatttttttcaactagatcctgagatacagtaattctgtatgtaaccgataagagaagaacataatatttatgtttatatgatgttttactctaggaaaaaataggcggaaaccaaaaatgtgcgttttcagcaggaatcaattgttcaaatgtagctagttctctgacagttacttgagaaactctgaatgttacatttattgttcagcttatttaccaccatatctaaggccctatagtcggattaaccaaaatcagtttttgctattatatgaacttcttcatctgcccttccttttcctgatgcatttttgtttagttttacccagtaaatcctacttccttgcccaggctggcatgttttcacacttaacactgtatgccctgttacccttatcaaaattcctatcctgttattgggcattagggggaacttagctttggttaaaagtaagtactgtgttactggaagctctaccttcatctactaatgtgcagttctaaaatgattaacagataatgcaatgagattcagaattagatggtgagaaatgtgaagatcctcaagcataaaaaagttttgaaaaatttaagatgtttttccccttagatcctgtaaatgggtttaatgttgactaactgttaaggcccactacccactctagctttacctcatattattttttctcaggggaaaataaaaagcctttcgctcttctccctgtgccaaagtctgtccaaccctttaaacattgtaaggcataacataagttactgtagaagtgggcacaaggacagtatatagagaaaactgggtttctctcaacttcatgtcatttgataagggttcagtaattttcttgtgacatttgactggcatttaatattggagaaggacagactttcatttccattttacatttaatactgttgtttacagagaagtttgtaataataaatatataatgcaaattaggctagtacgttttttgtccagaggttttacacaaatgctgtcttctaagtgaaatatgttttaaaacaagtagatggaataaaaattaaccactaagtcatatactgaaataaagtaacttgtgttgttttgcttcatacaaaatattatatagctgttttttaacactcactggaaatgactagaaatgtcatctgaagaatacaatatctcttcttctaatttttgtaatgagcttatcatttatttggtcatttattcagcaaaatattttgatattccactgtgcctgcaagatgaatatgacaaaattcatccactggaagagctctcagcttgatggcagaagataaatacataaatgaataatcataaaataaaatgatacacagactcatagactcagaaggaaatacaagagaaagattctcagtagtgatgacactttgaagaattagtagacactaaggggaaaagacactttcctaaagtggagaaacataaacaagcacacttatcaaacctctcaaacattctgctgttcttttaagatgaacggcctaatataaaagtgcaggtgagaggcgacttggaggaatggaaactcacatcaacactggaaactgaaggaaatagcaatctcccagaaattttgtctaatttttccatgatacagtgtgggaagaaatctctcagagtggactacaagacagcgggatatatctacatacagacaattgcagaggacaaaaaatactcaactcagatgctccagctgtagggatgataaagttgtgttgtctaccaacttctccctatgccattgggtagctaaagacattgttaaagaaaagacaaaaaagggacttacaactatttcatttttaagcatttctcattgtgtaatggaaagcctgtgtataatagacattgtgtaatgaaaagcctggtgtataatagatgataatagactaataaatgtgtactgttaatctcccaatttgtagcctgattgtccagcttgaaataaaaaagatcaagtttacttcgccattgagtccataggagacatataaacttcaagcttgtcagcagatctaggaattaccacttttccttccctgggcttatttctgccagcttatgtgtgaatgcataatccaacactgcgaatcccaattgccataaagtaatttataaaattgcttcatcgaagatttatatgttgattgccataatcctacttgatggtgtgtgaaaagatatacctaacaagtctcttaaagacatgtaagtgcccaaatgcaaaaggaatagataaaatgtagacagtagctttatttacatttcatgaggccaaccttgtcataactaacctctgtaaagtaggctgtcctttcccaggcagtctaggtgttgttaggggttgttcttacatcttacaccttaaaaatctctgaatcagaatgcccgttaatgagctacaggcactcagtgctaacatacatgctagctacaaggcctaatgttaccgacactcttattggatgagtagggttctcatgagattttaatttctataacatttagaaggaaaacatgacaatgaaaaaatgttaaaaaataatatgaggaagataataaatataaaaccattactcatttgaaagttcaattcattgaccaatattattattattttcaagatggttaatagcaatttgaaatgttagttttaactgatgaatgagcatcaattcaaagacttacagaaatttattgaagtgggtacaataaaacttttctacagactatatttacatatattattaataaatacccaatgtatttttattattttccttatcagcttaaaagtctggcacccaacaatgaccaaagtatataggactgggcctgtgcataatgaatccctagctgaaaatccatttagagcaggagttgcaccgatattacaaagtgcctggaatgcagactctcctatcatatacctatgaggtctctttgaaagatattccttccccacgctggcccaaggccacatatctctatctctattagcaaaatgagtcagaacatgtgcttctaaatccctgcttcacctcttagcagatatgtaatattgcatgaggaacatacccttctgtgcctctcttaacacacatttgtaaaacagaaataacaaagatagcattttcctagagttgtaaagatcgtataatttaatgtactatgactgtcaacttatacgtccaataagtgataactttttttttttttgagactgagtctcactctgtcgcccaggctggagtgcagtggtgcgatctcggatcaccgcaagctccgcctcccgagttcaccgccgttctcctgcctcagcctcctgagtagctgggactacaggcgcccgccacaaagccaggctaaatttttttttttcccagtagagacggggtttcacctgttagccaggatggtctcgatctcctgatctcatgatccgcctgcctcggcctcccaaagtgctgggattataggtgtgagccaccgcgcccgaccagtgatagctattgttatgagtggtgagttagcctactgaagaaccaaaactataattaacattgaagcagtagaacttgggggtcagaatggaaaagaaaggcaggacctgcaacactcatggacaaataacaaaaaagaccagtaaggggaggtactattccagaatatttcaaaaggtaggttatgcgtgtcgagtactcgtgagtggagagggaataaataagagaagccattggaacagggtaatcatggaagagatgatgtactgtaatagatgtgggtagatcaatacattgctgaaaactaataaatatgctatcagacttcagaattttgctggaatctctacccatgtattctgtttaaaggtgtggtatccacgaagccacctgaataaccaccttgctgccataagtgagatggttctaagtaccactttcaaagactcacctcttccccatcaaatacttagcaaatatttacaaaagaaaaaaaaaaaggaatgttttaaagctacagtatttactgttacaagtgagttcatcatcagctgtgagtctgttcttgtcaagacaataatgggtatggctcagaggttagtgtgattctttgtgtgagagaaggatcattcaaaaatcaattgattatttttagtaaaatatatgttcaattgcattattctcagcaaagaaagctcggcacttgatcaaatacccatcatatttttggcactttacctgtaaatctatcttcccgcaccacctaagtgatgtatctcagttggtaaataagcatgttattcaagttaattggattttggggtgcgattggtgagggtggaaagtatcctaattttaaaaatatctatgaaagtgaataaaaatagcaggtcaattccttaaaatgaaacaataggtagaaagagaaaaaaaaaaactagcagaatgtggttttgaagttttcacagaaaaagctcttcagctctttgtcacaccaactcaacattcacaattttatatgttttttgaaagtacttttttttaatggggagggaattactgtgattattagggacatttatataagaattttgtttagggtacataagtccaaggggataactaacaatgtgagatccagtaatatatttggaaatagaataggaatgcaaaaacagacaacaaacgtagcaaacttcacacagatgacaatattgaaaggcaccttgaagttagtcagaagcttctatatgaatatcagagtcgagccagaaaagcctcttaactccaaatttatctttacatcatttcagttatttgttttcagaaaacgtccaatgtgtataaactgaatctattttgtgaaatcctatcatcaacatttttaagtgcagattcctctctttagtgtttgtggtttcattctctgagttcctagcacaaaatcatgtgtgcctgattgctttataactggcagaccctctagatttaccagccctctagctgtcctgcagcctccagcccccacgacctagtgaactgcactttcttctgaagagtggaattcataatcttttccttccacccacaccagaaaggacacaaaactgtatatagtctctattttaatcgaagtggagctttcaaatgaaagaataacatcatgtccatttatctcttcatttgaatgtcctcattctggcattatagaggtgaaaactttgacatcagaaaagcctttagacatgtgcaaggtgggaagtctactttgacatgctcccttcaaaatgtcctgtctccctctggcaccaagaagtagcagggccattctggcatgaaaccctgagtctggaccagaacccacaggaacggagatcccatttctctctttcagggaacactcgagtctatcctaccactatatggggttgaccagatgcccccaaaaactctagaatgcagtgcacacccatgacagatttttcccatgggccagcatcacattgcttttgaagaatctcaggatattaggtatatagaatatataccaacagactaattaaagtgagtgaccaaagacttatgtgagtgattccaattatttacgtagataagagcgccaaaataaatacgttcttgaagcaccaccacacaacctagggaaggctctgcttgagataacatagacctaattcctttttttttttaatctaataaactatggcctgaggaaataaacatacccctcaaggtcatggagcaaatgtagaaatatagagcctggaataagactataggctctcaacaaaagttggtattcttcccagtaagccacactgaagcattgttgtgtctctcactattgtagatattaaagtcatatctctaaaaggatatttcagatgtattatgaatctaatttttatgactaaaataaaatttaggagaatatttgtttgactttgggataagggaaaccttctgaagcaaagacaaaaaattaagaggaaataaatatgtttaaaaattatgccttttacaattgcatggtcaaagggttcataaacaaaatcaaaatatacattgtacatcggaatcagtatttacaacacccatgacaatgatttagcattctcaatattatgtgtgtgtgtgtgtgtgtgtgtatatatatatatatatagtcgccatgtcgcccaggctggagtgcaatggagagatctcggctcactgcaacttccgcctcctaggttcaagcaactctcctgcctcagcgtcccgagtagctgggattataggtacacaccaccacacccagctaattttctgtatcttaagtagagatggggtttcaccatgttggccaggctggtctcaaactcctgaccttgtgatccacccgcatcggcctcccaaagtgctgggattacaggcatgagccaccatgccccacccaaaatatgtttttaataatagaacaaagaaacctaacataaattaggcaaagtatataaatagaaaaattacagatgcaaatagctagtgaggacatgaaaaaaaatgctcaacctcattaataaacaaggaaatataaaactaaaaccggctgggcgcggtggctcacacctgtaatcccagcactttgagaggccgaggcgggcggatcatgaggtcaagagatcaggaccatcctggctaacatggtgaaacccgtctctactaaaaatacaaaaaaattagccgggtgtggtggcgggcgcctgtagtcccagctacttgggaagctgaggcaggagaacggcgtgaacctgggaggcagagcttggcatctcagtggagctgagatcacgccactgcactccagcctgggcgacagaccaagactccgtctcagaacaaacaaacaataaaactaaaaccataagatattttcattttctcctattatactaacaaaactttaagaattttgataatattaaagttttggaggatatggggaattagaatattcagacactgctgatgagtacggggggatgagctaactaaataaattagtaaagttgctgcgagaataaatataaaatcatttctattttgttataggaaagaaaaccaagcttccaaaaacaaaagagttgtttacttatgcaaacatataaatgcaaatactcaaaaacagtaaaaatgttagcattgaatcaaagcatcttctatcatgaatacaatttctttcctaatcttattttattgttacttttgctagtgtgggaatgttgttttctttttagttaggctgccctgagatttttgtgcaaaatatgaatttgtgtcaattatttatgttttttctaagttattttttatgacttaaatgtccctgatggtatgtttagcaccttttaaattagtcatgctacctattttattaaaggccaggtttttctctcttccagatcattaattagaatattaaatatgttcatttccagagcaatgctccctgaggcacccattagcacctttgttctatgaaagtagaattataatgaataaaattataaacaataggcccaattttattttctattcaggagaaaaatgacaaaaatttaaaaatctagataattctgtctgctcactatgtttaccataaattatacatacataattatatataacattgagggggaaatttgatagctaaactatcatcacataaaggattctcaaaaaacttaggccttatttttaagctacattacaatttgttggctaggtcaattttttcagtgatattaacatatttaagcttctttgattatcaaaaacaatatcaactgttgtagaaatttgaaaagttactaaatatagaaatagcaaatgaaaagtgaaactactgcaaacctatgcagaaaattattaagttcctgtaaaaatgattactacttggttgaaaaagcatttagtagaaatacttcactattaattacttttcaacacaatccacatagcacacctgatattcatctttgggtggcatagcattttaaaacaaagatatcagaatcaagtttgacctcatgctggtgccatgataatcctattattatatacttcaagggatcagaataaggtggaattgactagtaaaaggtcaagaaaactccaacaaatataatagcagatgaaatttataatacaatagcagatatgttaaatgcatcacagtatataatagacactactcctagaggtgagacagaacacccaaggaagaccccccctcctcagtcctgagatccaggtcatgttgggtaaggcaggatcttggctccctaatgacgaagaacacatatgatggcacattgtcaatacctgctagagatttgcgatctgaaactcgctgtttaatcttccctctagggggcgctggcaaaagctattcacaaggaggcgtctcattggaagcactctgttttaaaataagtttagaggggacactggaggaatgcaaggtcctgatgactgttttcttgggccatttccaagggttggggtgcagggaacaattttgagggatgttcaggaactttggaggatttcctttctcaataatatattcctgtgccttcctagtgtgttcttggctgaaaacaaaaaccaaggattatgccactccactggccattctaattaatctgactgacagaggctaggactaaatatttctgatagcatttaattaaggctactctcaactgaattccatccatcatgatgaggccaacctgtagttttgcctgcaattacgcgccacccgcaaggaagctagacttagccaactgtgaataaatttcagaagggatcaggaggtctcatcttagatagcaaagacatcgtttaaacccagactatatcaatcgtgacctgtgcaaagaaatttaggttaacctgccaaactttggtgtcactgacaacaattaagaggacaataaatgggccacaaagaatccctgtttaagggagtgattctgtggctgccaattgacccacatagaaacacagaacaaaaaggagcacaagtaactgggatttgttgcaaaatgtgatttggaccaccatcacactggattggtgaaaaaacataggcagtatcaccaggaggttgcagacttcactgtcagttattgttttaggaagagcagaaaaatttaagaccagctatgttcacacacaattttctgtttttgtggcacatggacagactacaatcccagcagcaagtcacactggcagatggagttgcagtttgattaggcagtgatgtccatcccagtccccttttaaccccttggatctaatctcaggtactaaagttgttgctctccctgcaccatcacaaaattggtgtgttcctttttagtaccgataatttcacttttcctctagttacctcctatttgcaccgagatttttcatctgaaagagtcaggaacaagaaggacaagagcatttttaatccatatgaatgaattagaactaaattagaatcttccaggcttcttttgttcatgctgccatgcaaaatgtataaaaccaagctggcctgaggttgacaatccaagaattgtcaacacaaaattccaaaatttaaaatagatttatgtgtcccctaccacagctcttttgttctatttttcagaaaacagccaagagatgttgatactttttagggaggacagccatatttagtgaccaaactatcttattaaaatatatgaaccaagaggagatgaaagaggtagaattagaaatatttttgagttgacttttcatgaggttatcccaatgctcagcaattccagatgtctgtaggtgacatgcaccatgcactgtggcctcctttaccatgagacaaatggagtaactctggacaggagtcaggtataacatgtgtctgtatcaggagtgcaacttctcagaaaatgaatcataccatgaggatcttacattagttggccaggcaatctgatcagtggtaccattgcttccacaatttggggccccacagagggatgtcttttaccttctagcctataatcttcctgctgaaaagtcagcaaaaatagtataaccagtcttgtaaaggagagcattggctagagctatgagcgtgaaattaagttctgcccactgaattgagtgcttaccttaattttcaattctgcatagctgtcactgaatgtggacagtacaccagcccagtggacaaaattgggtttttaactcagccaaacttcagtaaaccatgtctgtccacatatttaggggaatctatgtgaactgagggcttaacacagccaggggcttcatttcctgtgggagaaggagataagatttcccacaaggaggtagttgacactcctttgtgtaaaactaagatggcactaggaccttgtaattgggtataccatgttcacttgactaagcaaggccgactgggccatttctttgctagtcatcaattctgtgtggagatattaagacagaaagcaacaaggcatttgcaaggcaggtgaaagaaagaagaaagaaaggaaggtaggaaggaaggaagggagaaagagagaaaggaaggaaggagggaaggaaggaaggagaagaaagagaaagaggaagaagaaagaaaggaaaaggaagaaagaaagaaaatgaaagagaaagaaggaaggaagaaaaggaaggaaagaagaaagggaggaaggaaggaaatggacagataacacatcgtacctacatcaggctggcagcactgctgtaactgaaaaataacctttgaaaactcaggagctaccaagtcttcaataaaagttgttctttcctttttcttgtgggattctctattgttttgttagactgcatgaaagagagcaaggatcacctctccacatgcacagtccctgaacagaactatctcctttgattctttatgaatatgtacagtagaatcacaataaggcacattaatatcaattatttgtttctgcacaataatgtattgaattgacctagaggcctccatccacccatcagttggactcaggcactatttctttttttctaatggggatttatatgccccttgtatcagggggctgaaatagttgccaagataatatgctatgccctggcttagcaagaagaatataagcagaggctactgaatgagggttggttggtggagggggagattagcctcagaaagatggctggggcttaaaaggcttttttggtccccctgggtggatgccacctcatgcctggtataccttcaaactctttcaagtgtcgtggcccagaggtctcttttttaacctccttttcccaatgtatattctcttccttgcaacctgcagtgccaaccctgagaacacagaggctgtggagattttttaattttgtcaaatgcaagtatgaaagtgaaggatgctttgatcattgcattatcaatttaataccactgagttatctatgatcctggcctacaggggtctttggcttaaatgaaatttttctgcttctacgcagcacgctaggcatgagaaacttcaattcttgatgagaatttgagactagaaatttctaaggcaaaatcttttttaattaatagaaattatgattgcccaactaaagactgagcaaaatctctcaaatgttctcctatcttacactctctggaaagatagtttctggtatttttggaggaaacctgtctatatattaatatatgtctagaaagataggttgagctatattttagaagttgttaaatactacaggatattgggttgtattcttaaaactatgagaaaaaaagaaagcctttaacaatgactttagatgatacatttatattccattaagattactctagcagcattagagctcattttttaataaataaaaaggctaggataaagaatctccattaaaaacccattagaataaccttgagcagatatgttgaagtcttaggccggggatgtaactgtagaaatggaaaaattactcctctggggggtaaattaaagaaagataaacagggcaagctgcctgttaatggcatgggaaaggaggtaaagcagaagaagcagtgtgagaaaagtgtggatgccttagaggagggtggagccattaaaaggactaggatacaagtgagcgacaacctacttgacaggatttgagagaaagggataaaatagactgcgctgaatttgaagtttctgtgcaactttaagaggaaatgccaattggtggagtgactacataatttatctaccattcaaatgagtatattttaaagtgaaatgaatgcttgtacgtagttattaatagcaattgacataaattcagactatcccaagtgagttgggatagattgccagcccacattgggcgctatatggcagttgatctcaggagagagattctagttgacatttttaacaatagcggtacatgttaataacaccccagaaaaatgtgtggcgatggatttgcgtttgtctttatttacagcaattggcatatcacttcacggtttattaagagttttattggatatcaccagatttgataactgaaacctaaaaagcagggagggaggtcccatcctgcactggtaaaatatatctgtttcttcttatatccttcaaaatatttaatactatttgaatactgcagtaaactataagctccatggaggtttttcttgttccagctaaagctatatataccccaagaagtaaatacaaaattcactgtgacaaatgtatcattttggaagttgttaggatgtaaattatctgactctcaggaaaacattttggttcatgttaattgtgtctttgagtctactttctgagatgtgttctctgaaggagaaagagaaaagattgtgggaataaaagcaggaagaaacctataattatattgtatcatgatatcaaatagaattaaaaatttgaacatgtataaggaccctcagataattataacacagtaatctaatctttgaaagtcttcaaatctatttctcagaaacaaatagaatgaaaagcagctatcctctctcccaagattgctatagcagacatgagaaagggacaagcgtctttatttttttttatagctgatttaaaccttgccaaaatccactatccagatgctcagagaaaagatgtaaacatttcagttaacaaggtatcaatattttctggtttaaacagtccaccttttagtaagtgcttagatattcagctcctccctccccaccttttgcaatccaagatggtgtctgaatatactgcagagctgctcactttttgcacataataatgtaggaataggatcttaaacgcaagtgtagttatttctgctcttcaggttcttgctggcttctgatgatactttctgtggtcctctgaccactgttctacctgcacacttatgatgttaaggtcttcagagagtgaacttgtgacatgttctttcagcttggtctagatactgtggtcttccctgttgacccaggatggcttcagctcctgctggcaatagttataccctggaagtctctctgaaacatttgtccattcccaatttctccttgtaacacttgagcctttccatacagacctaactcaaagcctactaaggtcgcaccttgcacgttctcatctcttccacattcatgcatagaatttgtgagaacatctgtacaacttccatataatgtgacattgagggtagactcccaggagctaaactctggcctctgtctgcctatctagctactgtttatacactgactagcttgtccaggttggcataaccacccccctcccaccccaccccaccccacacacaaagaaaatgtcctcaatgtcttaaacagggaatcagatgaaaaactcctgtgtttcaccattcagagactgggggacagggcgaaaaggagagggaaaataacattgcatacatgtcaccaccttctccttctcacaatctacccaaagatggaataagcaggttttctgtttcctattcctggctacatgagatttctcctaagtctatccccctttttttttttttttttcttttttctgagttggagtctcactctgtcacccaggctgaagtgcagtggcatgaacaagactcacagcagcctccaatttctgggctcaagggatcctctctcttcagcctccctggtatatgggattataagcctgatccactgcacccaaacccctttctttcttttttttaaatttattattattatactttaagttttagggtacatgtgcacaatgtggaggttagttacatacgtatacatgtgccatgctggtaagccgcacccactaactcgtcatctagcattaggtatatctcccagtgctatccctcccccctccccccaccccacaacagtccccagagtgtgatgttccccttcctgtgtccatgtgttctcattgttcaattcccacctatgagtgagaatatgcagtgtttggttttttgttcttgcgatagtttactaagaatgatgatttccaatttcatccatgtccctacaaaggacatgaactcatcattttttgtggctgcatagtattccatggtgtatatgtgccacattttcttaatccagtctatcattgttggacatttgagttggttccaagtctttgctattgtgaatagtgccacagtaaacatacgtgtgcatgtgttttttagcagcatggtttctagtcctttgggtatatacccagtaatgggatggctgggtcaaatggtatttctagttctagatccctgaggaatcgccacactgacttccacaatggttgaactagtttacagtcccaccaacagtgtaaaagtgctcctatttctccacatcctctccagcacctgttgtttcctgactttttcatgattgctattctaactagtgtgagatggtatctcattatggttttgatttgcatttgtctgatggccagtgatggtgagcattttttcatgtgtttttttggctgcataaatgtcttcttttgagaagtgtctgttcatatcctttgcccactttttgatggggttgtttgtttttttcttgtaaatttgtttgagttcattgtagattctggatattagcctttgtcagatgagtaggttgcgaaaattttctcccattttgtaggttgcctgttcactctgatggtagtttcttttgctgtgcaaaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaaatctctaatccatcttgaattgatttttgtgtaaggtgtaaggaagggatccagtttcagctttctccatatggctagccagttttcccagccccatttattaaatagggaatcctttccccattgcttgtttttctcaggtttgtcaaagatcagatagttgtagatatgcggcgttatttctgagggctctgttctgttccattgatctatatctgttttggtaccagtaccatgctgttttggttaccgtagccttgtagtatagtttgaagtcagggagtgtgatgcctccagctttgttcttttggcttaggattgacttggcgatgtgggctctattttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagagttccttcacatcccttgtaagttggattcctaggtattttattctctttgaagcaattgtgaatgggagttcactcatgatttggctctctgtttgtctgttattggtgtataagaatgcttgtgagttttgtacattgattttgtatcctgagactttgctgaagttgcttatcagcttaaggagattttgggctgagacagtggggttttctagatatacaatcatgttatctgcaaacagggacaatttgacttcctcttttcctaattgaataccctttatttcctcctcctgcctaattgccctggccagaacttccaacactatgttgaataggagtggtgagagagggcatccctgtcttgtgcccgttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaatgccttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggattcggtttgccagtattttattgaggatttttgcatcagtgttcatcaaggatattggtctaaaattctcttttttggttgtgtctctgccccgctttggtatcaggatgatgctggcctcatcaaatgagttagggaggattccctctttttctgttgattggaatagtttcagaaggaatggtaccagttcctccttgtacctctggtagaattcggctgtgaatccatctggtcctggactctttttgtctggtaagctattgattattgccacaatttcagctcctgttattggtctattcagagattcaacttcttcctggtttagtcttgggagagtgtatgtgtcgaggaatttatccatttattctagattttctagtttatttgcgtagaggtgtttgtcgtattctctgatggtagtttgtatttctgtgggatcggtggtgatatcccctttatcattttttattgtgtctatttgattcttctctctttttttctttattagtcttggtagtggtctatcaattttgttgatcctttcaaaaaaccagctcctggattcattaattttttgaagggttttttgtgtctctatttccttcagttctgctctgattttagttacttcttgccttctgctagcttttgaatgtgtttgctcttgcttttctagttcttttaattgtgatgttagggtgtcaattttggatctttcctgctttctcttgtgggcatttagtgctataaatttccccctacacactgctttgaatgcgtcccagagattctggtatgttgtgtctttgttctcgttggtttcaaagaacatctttgtttctgccttcatttcattatgtacccagtagtcattcaggagcaggttgttcagtttctatgtagttgagcggttttgagtgagattcttaatcctgagttctagtttgattgcactgtggtctgagagatagtttgttataatttctgttcttttacatttgctgaggagagctttacttccaattatgtgatcaattttggagtaggtgtggtgtggtgctgaaaaaaaatgtatattctgttgatgtggggtggagacttctgtagatgtctattaggtctgcttggtgcagagctgagttcaattcctgggtatccttgttgactttctgtctcattgatctgtcaaatgttgacagtggggtgttaaagtctcccattattaatgtgtgagagtctgagtctctttgtagttcactcaggacttgctttatgaatctgggtgctcctgtattgggtgcatatatatttaggatagttagctcttcttgttgaattgaaccctttaccattatgtaatgcccttctttgtctcttttgatctttgttggtttaaagtctgttttatcagagactaggattgcaaccactattttttttttccatttgcttggtagatcttcctccatacctttattttgagcctatctctgtctctgcatgtgagatgtgtctcctgaatacagctcactgatgggtcttgactctatccaatttgccagtctgtgtcttttaattggagcatttatcacatttacatttaaagttaatattgttatgtgtgaatttgatcctgtcattatgatgttagctggttattttgctcgttagttcatgcagtttcttcctagtctcgatggtttttacactttggcatgtttttgcagcagctggtaccggttgttcctttccatgtttagcgcttccttcaggagctcttttagggcaggcctggtggtgacaaaatctctcagcatttgcttgtctgtaaagtattttatttctccttcaattatgaagcttagtttggctggatatgaagttctgggttgaaaattcttttctttaagaatgtagaatattggcccccactctcttctggcttgtagagtttctgctgagagatccgctgttagtctgatgggcttccctttgtgggtaacccgacctttgtctctggctgtccttaacattttttccttcatttcaactttggtgaatctgacaattatgtgtcttggagttgctcttctcgaggagtatctttgtggcattctctgtatttcctgaatctgaatgttggcctgccttgctagattggggaagttcccctggataatatcctgcagagtgttttccaacttggttccattctccctgtcactttcaggtacaccagtcagacgtagatttggtcttttcacatagtcccatatttcttggaggctttgctcgtttctttttattcttttttctctaaacttcccttctcgcttcatttcattcacttcatcttccatcgctgataccctttcttccagttgatcgcatcggctcctgaggcttctgcattcttcacgtagttctcgagccttgtctttcagctccatcagctcctttaagcacttctctggattggttattctagttatacattcttctaaacttttttcaaagttttcaacttctttgcctttggtttgaatttcctcctgtagctcggagtaatttgatcgtctgaagccttcttctctcagctcgtcaaagtcattctccgtctagctttgttccattgctggtgaggaactgcgttcctttggaggaggagaggcactctcctttttagagtttccagtttttctgctctgttttttccccatctttgtggttttatctacttttggtgtttgatgatggtgatgtacagatgggtttttggtgtggatgtcctttctgtttgttagttttccttctaacagataggaccctcagctgcaggactgttggagtacccggccgtgtgaggtgtcagtctgctcctgctgaggggtgcctcccagttaggctgctcgggggtcaggggtcagggacccacttgaggaaacagtctgcccgttctcagatctccagctgcgtgctgggagaaccactgctctcttcgaagctcagatggaaatgcagaaatcacccgtcttctgcgtcgctcacgctaggagctgtagaccggagctgttcctcttgggccatcttggctcctccacccctttctttcgtgaagtgattttccccctgcacacttatgtagtgtctattatatgcaagagttgttctaaaagctttacaaaaattaactaatttaatcctcataatagcccataggataaatactattatttttctcattttacagataaaggatttagctagatagtagtaaagccaggatttggaccaatgcgatcttgctcaaatcaaagcttaatcactaggctgtgtttcttctttgttaggtggttaggtggcatgactgtgagaaaatatgaattacacattcattaatttaatattttcaaaatattatttaagctcatttttttcctaaggtatcaaaatgaacaagaggatatgggaagattgtgtaagtcctgaagatggtgagagatgaaaaagaggagaaatccacagtagaagaataggtggtgctaacttaaacacgaaaaagaagagtacataataacattaagaaatggtccttgggcttaacaatagaaaggtccattaatacattcattagtgaactaaagtttgaatccaggccttctatgctgaaattttctcctgcttcctattcttcatattcattatgaagtccgcttttcatcttatatataacatttaagtgctcttctctcttgtttagatttgtttgaagtgattgcaaattgtctatgtgataagacagaaataggtttattaatgatttagttcttgcctaaaacataggtttatttttctatttcctaaccccacaccatgcaattgcattttatgaaaatgtgaaactgaattattggtagttttctttaaatatgtcccttaattcccttacatttctggcctttgcacaaaatggcctttctgcttaatgagcatcttactgaattctcttggtctctcctcttttcccattgtatgcacaggcttgtctctttgaccactttctgtggtcctttaggcatcagccttcttgtgaagactttctttcttttttttttttttttttgagaaagaatctccctctgtcatccagactgagtgcagtggcatgagcatagctcactgtaacctcacaatcctcgtttccagtgatcctcctgcctcaccctcccaagtagctaagactataggcatgtaccaccatgccttgctaactttttttttttcttgtagagacaggttcttgctatattgcctaagctaatctcaaattcttgggttcaaacaattctccttccttgacctaccaaaatgcatgagccaccacatccagccaagatttttgatttccagagaaagtttctgcttccttttttgagaatgaaagtagttactattaacaattgcactagtacaacacatgtaagccaagtctatactggcttgcaagaaccaattttgaaattttcaagaattcagcaaactggctattaagcccatcagtggcttgaaattgactatggtgggtgtatttgtatcatggaaatctacaaacacaacaaatctgtttttgttattgttttgtattgttcttctggagagctggtttatcagcacatctatgaaaataatacatctatcatacaaatatataagtattaatataaaatgataatatggttaatgtaattaaggtaacttaggcaaacaattaaggtgatgctatattcttcatatttttacccactttataaaagacagtttcatttctctaaaaaaatttccctatagtcaggctagaacttcaagggaaaaaaatctgtattctgaagaattaggtctgcatttacatacgctatcatcagcaaacagcacagttatagaactatgaaaattgcagacctttacaacctggcctttgattaatgacttaattaaagtaggattaatataaatcttttggcaagaaagaatgctagtgaaagtggaaaatattctggcaatttacccttttagcaatcattgtaagaggcattgataacaggatgatagagtcaaacacttgaagaactcctggaggaaaggctgatgtttgcaagctatgcaaaaagaaacaagaagcaaagaaataaaatttgaatgaccactactaagccaatgtataatataacatacttttaataaagacccttagcaaaaatttctctcaggtcttggtagcgggcaaagctgactttccatcattaattgtttctaactttatgcacactatgaatcttgtaactaatcctgtttgttttccttttttgatctgatgtctgggagattagagctatatttgtagcctaaatatttaatgtatggaaccatgagggcataagtgtgaatgctaacccaagtcccacgtttactcttctctatctttattttccttttgtctaattcttttacctttatttcttcttttgtagtgtatgcatttttgtaaatcaccctaagacctttttattctgaaatggggtctaaataaatagcacaggcatgagatgggcacagcagctagttctgtaaaccacagttgcagtgctggtttcaagggactattgtgcccattatttcagcttctgctaaaaaaggccctagcatactgatatccaaactaattttgtagttatgaaaattaaataaaaaaggttgggatgtgatcaatgtaatatggtaacaaaggaattactagaggccaagatttatccttcaagcccccctgtagttactaacattggaaaatgactggttaatgacatgctggttgcttgggcaaattatgtcttccttgatgtcaaggacaatgattctttgggtaaacttttctcccagtaacaggaatacgatggtaacctaatgatgcagtatagatgcttatttttagcctatactattactccacaatctaagttatagttacgatagttcaactatacatgttagtgtaaataaggctttacatattaattttaacagtcatatagtatgtgtgatttacttttaaaaggcaaacatttgttccatcagaatatatacctttaggctatgtatttagccatcatcactcagaaagaccccaaaatgtcttaatattatgtgaatgagtgcttgtacctctggagaaaagctgtggcatctaatattgatgttaattcaacgggataaataaaatacgacatgtaagagtccataaaatcaatatgttgatattgatatactgttttatttctatgaatttaagtgtttttgtacctaaactaatttaaatataagtatgtattgatttatatcatttatatacactttagctagctaaaatgcccccttttcttctcattggactataactgatatttttacaaggttagaaaattcagaatcctttatagaagatggcaaggtaaagaaatttgatggggaataggaaacaaaggggatacatacagagttacagatattgatattttaaaatcagcttttgtccgtaggcttatttgtgtaaataattctgctgggattagagagaaataataggtaaacacggcctagattttgaaataaacctagcctgtttcacaacaaatccaaaagagccagtgttaattcagcaattactctacattaaaggcatatttagggtaagtacttaaattgaaatgtgacatattttaggacagacttctaagtatttctttgcattcacagacatgaagccgctgaagtcttcagtgtagcccagactttgtgtggtgctctttttaacagtgttcactttttaaaattttaaactatgcaataggccaattcaaaagacaaaaaaatactacagttttattttacttctctttaaaaacatatacatgtattagcatggggaagatattgtattttcttataacttaaaatatctactatgtaaggtaggtaaataaaatttacactggcatttagccggacaatactagaatctggctaaatctgtggagaagaacatgaaggcaattttgtaatctttaattctgtacatatacctttatagaaatcacaatatgttcagattaaatatctgattttagctcttaattgaagtggatgttattattgccattttacaatttttactatagggataaattataaaatgatgtgccaaaggttacatggtgatagggctagaagtaattcattctatttaatgcaatatttttctcagcagctgttgtttatgcaaatagtcatgctgggcactggaaatacatggtatacaaaattctgttctaacagttgtagagaaaaaaggcaatagaccaagaattctgtctatgtccaagttggctgttttagaaaatttatttctctcattcctgattatttgagataaaagacaactgaaattattatatcatcaactgcattagaaactcaggaagctgcatgtgaccagagaaataggagcatattttaacagagaaaaaagagacagagagagggtgggtgttgggggtagagagagataaattatgagtctctgaaacgtcagactcaaccatgttaaaatatgtaatttcacgttgactctgcttcttgccacatttatgctgccatttagcatttctataaacataataaactgatcatatgtgaaaaccttaatgtttatgtaattacaatttttttatatataaatgaataggtggtatgttaggaaacagtttccatttttcttagaactttgtggcatgagtacatgattgaaatgggaaaagaatgggtagaagttttaagatacacttctttcctccacattgttctaagataagaggttgcagagcaggcttttattatcaggctgaaatactcaacatgtaaatgtgaaaatagttactgatttttatccccacctgacagagtaatgagaaatcatcttttcaaatgaaaatttatttttgaaacattgtgtagtgaataacaatgcattttaacttaaaacttctaattcagattcttatacagtaacataatatttgttaaggaagaacaggtatttggataaagaaattgggaaagcagtgaaggtgttgatagatttttcaaactatagacaatgttcgaatcttccatacatgtgcttaactgaccataaatttaaagtagattgcaatgaaaaaaataccagtctataactaaagcttcttatgataaagatcaaaattaactattgaaaaccaataaaaaaaatagaacaaaaatttcacataccatttgggaatagaaagaaactatctataaaatgtgtaagtcctcaacattattttgaacctatccttcagccttatcgctgtgtaatttgcaggcaccaataggcatctgccctgagaatagattattagcactttttgcctattttgctaattaaattcaagtggtatataaatcccacttaaggtataaagtgcagaaggtgaagcagagaaagagaaaaatcaaagctcatgaaataaaagacagaaaatgtcttccctcgagagtcaatattcaattacttctggctctatgatataaaaatgtttttaaataatattttaatggtaactactgaatcacctttggaacaaccacttaagtaaataatagtctttaacatccctgtgaacaatgtggtaaaataacatgaatgacatatcacatataaaattcaaggcaaactttcttctgtattttaaaaagatggttttggccaacctacggttgcaattctatgacaactctcagagtctgtaattaatgagaaagacaaattgagagagggagattaacacctgtgattcgatggtcattaagtcacaaatgtcctatgtcactctgaccatattttctcattcttcctctgctttcccttaatgcccacaagaccttctaaaatcaacgggttgcaatattagtcattacatcattctgttctcacctcgattagccaagacctgctgtttcttctgcctgattgaagctagtgctgattgagaacaacaagaaaaccttcctacaccttcctaggaaaaataacaaccaatttctttataaatatttacattgaaacgttatttatatgaagtattcttaagattaaacatacctgggtatttcctctgggttccacagttttaatcctgagtcagggatttatagactagtgaaagttctatgaaagtaactatttaattgatccagatttatttagttagtaataattttgctgctctacgttacccaaaaatatactgaccaaatatttggtttggttgctctgtgtaaattctgcttctctttatactatctccattaagtaacagatgattgacctcatgattgtttttactgaaatgatcaagtttaaattactgaaatgtgtctgctaagtggcttgtaaaattttgcatattttctcataaaaaatgtagtttaaaatacagtgacatctcatatgtcaggccactagacttctgccaacatcatatttccaaatctactggtaaccaaagaaagcgtctaagagtcgcaaaacatttggttgaatccgtgtacctaattcccatcttaagcttcatgatttttcaacattaagaaaacaaacaaaaaacacaaactttcccatcaggatactagaagctataaactgaaagaaaaaaatgtgagaaaggcacaacaacagaataagttaaatgtcacagccagaaatcaaaggacaaaaacgcagccatgaagctgtatatagagagaatatcaagggatgctgactgagatgatctgggggtatcaagataatattaaattatattcgatgacctctgattgaattagtagggaaatatatgcttaatctaattcctatacaaagtatcctatactaaaaaccattgctttggtgcctgaaggaataagccccggacttcattgcttccaaaatttaatgtgcatataaaccaccttaggatcttttgaaaatgtggatgcttgtttggcaggccaggaggtgtggtcatgattctacgtttctaatctagctaatgccactaggtttttttttgtttgtttgttttgttttgtttttttggcaagggtatggaatgcattaattctcaataaaataaggtagatgagatgttactgtatttgatctcaaatattttcttggaaatctgaagtaaaaacatactactcttacaagtcggcaagtttatgtcagtacaattcattcactttggaaatgaggaaatagcataataataaacaatttttaagacgcgaaacatgtaagaggggaataaataatagtgcattattcagtccttcaaccatatattaagcatgcatgaggaaatttcattaaaacctgaacttggtcaatactgtgcaaaatttgaagtgagctacatctatatcatactaagtaatattcaatagaattctgaattctcttaatctatattgtttcattctttttacatcatctggaaaataagcaacacacaaggcaagttttttaaaggatattctgttttcatttctacttatgatgaaacactgtgctttgttcaatggtaaaaaatcaagaccatgttctttgattttaaaaaatgcccaggcaatgatttcctggttctggattttaggcacataaatatgtgcattaaaatattctataaataacctgaaaatggaagaagttaaacacaacatttgaagttatgaattcatagcctttataagctttatatattatatacatttcaaccctgccaaattcctttactctgatatgctgggtttacaaactattaaagtctagtgacattaatgtgagacttccctaacctcaccatgtcttccattatgaaattgtcgttctagatgcattactgcttactcgaacctttctcacttccctaaaagcttttgctaagggtgagatttccatgttgctccaaacaattatttaacctcaagtgattaaactaaactaaagtatctaccatatttgatatgagatgaagggacaagagaatattgtaaataatattgataaaaagacatacgacttcaagtggtttcctaaagggtcaagatataaatgtatttatggtaaaatgtgaaaacctttatacaggacaataaagaaagaaaacaagctcatgatttaaaataattaattatttacaggtgattccctcatttactttactttgcaattctagctttcattttaaaaattagggcagtatagacagcagctgtataaactcattgcctgtaaatatcctcttacttcttttttgcccttttggctatggaaaataaaattacatgtactaaaaatgttttgtggagctagaaataaagcataatctatgttaatcaataaaatataaatgattatttagtaattatttcttgtttattaaaatgaacaaaaattcaagacccaacaaaacagctaaatgtttaaacgataggttatttagtgaaagtatgtccaaaaggattttctgggaaaaacgattaattgataacaatgtgagtgcaaatctgtctcttaaaattttaaagcatattgttcaaagttttagcttgtgtgcatgatataaattccatacattgttttctcagtgacaataaaaagcacagtttattaaaaatgtaagtaaaaattaattaaaatatcttttaaaaaattggtcacagttttgtcattggtatatggaggttgttccaggggcccatccaaagctcttcatcatcagactgtgtgtggtcactatgaaattccaaagcctccttgatgttcttactgtcaatcatggactcctgttcaactgtgcttttcagcctgttccttagtggcttcaccgctgtattgtcagtccccacagggcaaggggcaaatgtaaccagagttggtcttgcattcattttttcagtagaaaatggcccctttgataatgtgttcagaggtacattctcctcatgtgtcactgccaacttgtctagtttcttaaagggccctcccagtcgaacaggggaagcaacttttaagttgtccgtgaggcaggcacggcgggttctcaccacagaaccattctgtgcaatatatatattgccgttgatattactgtggatactaggatggtgaagacggtttctctgacattcaggagcactgtcttctccagttgagctggtttcatactctcgatcaacaactaacttgatcattctttttcttgcccactgataaaataaacaaaaatatgtgagtcactatcaaataaattaaaaaggcaatgattacattgcctgtgaaatccaaaacaatgacatttagaaagctgtcaaaggtaaatcactcaagagagatagaaggaagccagtctttattaacatacatttcctttcatcaatcctttattggctttagatctttcttattaatgtttgaaaaatgtattgttgagttggaaagcagacatttcaggaaacacatgtattcttttagatcaaattactgatccacatggaaaaaaatgtattacttttatttaaggagctgatccactatttgacagctgctctactattcaggaaagttaaattgaaaggaatgaacagctttagtatattctgttcatattaacgcttctattcccaatatttaaaaaatatttttaaaccacatcattctaatttttaatgtattctctagttagcgaaaacttttgtataatttaatgcattttgtataatttaagcatttatttacttgactttacttatttacttgatgtataatttaatgcatttatttacttgacatatcctggttttctgggttgtcccatttagatatactaacttaaaaggaaatatcttctcagcctgcatcatttacctagtaatacacaaaactgaaagctaattattatactaaactttccttttgtaagcaactggacattttcacaaattcatttgacttttaccaatcaacattaaaaatagcaagaagcaagggttaagcaatactgtgtttttctcaaaatagtatcgcatttttggaatatgtgaactatcaacacattgcatgcattctcattttcagaactatatttcaaaattatagtttatttacctagaaaaaattttatgcctgttacatttatttttaaatccactgtagctaataataacagaaaataagctgtaataacttttaattaattgaaaaatgttatttcattgaattcctaatacttgaagttgcagatacaaacttacttatttgaacatgttcatgatagtttttataatacctttgccagttgaaacgtacatatatgcaaaagtagacgactgttaaagatataatttgttgaagcttgtcttagtatttattttgaaagatgatataaaaacatatatagtgtgtgtgtgtatatatatatatatatatatatgccatccattccaatagacagagtgtcactgataatacataatgccacattgcattaacaaaaatcctaccagtaaatattaaatattgattagctgattgcatgtgttctgatttactaatataggaaggattagtcagttttactctaatacagtctaatatacaaatggatttggacaacatatatattcacttttctggcatgcttctgatcataagtcatatcaaaatcttgatcaatttcctccctttcaagtgtcactttggagaacacacagaaggcactgcacacgagagcactcatcacagcaaaacttccacctactgtgatctctttcaaagtgctgtgttgtaaccttcagagtttgctcctggcgacttcttttggtttgcattcttgcttctgtcatacgctggtacctgatagccccatggacctccagactgactttcgctactactgctactactacctgattctgattcctcctcactttccacacctccttccaccgaagctgattctgcactgccctcttcagggatatcttgagcttcagggtctgtactttcttccacaggggctggtccactttcttcttcttctgagtgttcttcttcttccatcttaggttctttttgttcttcttgtggctcctctttcctacccttgacttccttgacctcctcaaccatgggccttcttcttgcaagcacaatgtttttccttgctttttctccttctgactctgtggattccgattcttctgattcaggggtggaactctcctcctcctcagagggtgtctctgactcagattcctcttctgtagtctcagactcactgaactcagactcttcttcactgtattcagtatagtcgctggaggattcctcctctgattctacagtgctttctgttgcttcctcttggtccagagtgagtttcaaataatctttatcttcttcctcaaggcgtctctgccactcttcaccctcaaggtcaacgattcctcttttatcagctaatcctctaactttcttaaaaatcatggggaatattctggctctcttccatgttgtgtatgtaggctcagctgctggtggtttttcgatagttacaactacttcttcctcctcactaggctctctaatttcaacctttggttttttaattttctttggctcttcctgaaaattgtgaaaatgcaattgaagtgtcagcttggagatagctatggtatgaccttgtcccacgaaagctacgcaggaatgaatctgtgggtgatagcttcatgcatgttatataactggcttaagaaaataatcacaaaaatttctactgcatatagacagaaggtgattaagagaaagtaaattattttattttagcttgtactttacaatacccaaatatattaatttccttcttgttactcaacgtttaattttcctcttagatcaaataaaaaagaaagaattattgtctcttccttccttccttcttctgtcactagacttaggttaatagctttctgtattcccttgaactaaattttcaagaattttcaataatcacgaaaatatgacgatttatctcattttatgagaaatctattttatgaaattttgcacatgttaaagccacagtgacatttatttcttgttagtgttgtttttgtataaatttgccaagtaaatagtgaagacaaagtataagaattttatagaaatgagtcatgctaatttaaacataaattacattattccttgaaaattatttgtggaaataatttacttttctctgataattgaaaggtggagactatattttttcatgacttttagttttgctagataatgtgggagcaaaagtaacctttgtattgcagaactttaaaatatatttgcttataatatctttatggagcaagatttagaattttagaaaacataattttcattgtgccctttccaaatgtttaacacttttagaaggaaataaattaaatgatcaagaattaattttcctccaaagacaaggcaatgaaacggtcagcactgtgaaatttctatgggaaatacgtactaagtgaaaggaatttctaaaagctgaaatgttctacagccgctagtcacgtagggttaaacaatatttttcttggaatattatcttacataataaaattacagtaattacctcttcctcctcatattcttcctcagcttcaccaaccacctcaccatattcctcctgtccagctggtggtaacaatcgacggcgactcccatattgaggcatttcatacctgtaatataaacttacatctttaaacagtttgtcatgtgatttctgtagaatctaccatgagtgatctgtttccttctttttcttccgccattcaatcgacagatatttacacagcacctatcaggctccttgtaaactagttacaaaactatagagtaagaactgctacctgatgaccagtgatttttgccataatggtaccctggaataacaataaagagagttgagttatttcagatactcgtttttggagaaactagaacgagaaaaaagccatattgtgtcttaactagctgaagaatccagaacacaaaatagatactttggaacagtgtaatggctcattcaccacattaaatctgtatgttggtagcaagaagttgcttcaaacatggtctgtaatggttttcacaatttcttcagtattttttttgaaagtggttaatttatatgtgtacaagtgacttttgagacacttatcagtggattctaaggtgtgttttctgtttcctaactgctcttgggcaaaactttaaactgattagataaaacattaacatcttatatgaaagaaatggtgaatttaggaattgagcaaatatgtttcacatctatttcccatataaataattttgaataattttaccgcatttctagaattgcaatcgatatcaatgtaaaatatcaatatggaactcaatatagaaaaatggttaaaacttggttaaaaataaagctagatatactattcattttcaagtattatactagtgagatcgacatgacattaaaaacaaattctagtaataataatcatttaataatttcctattaataaaatattaaaataagaatctgaattttaaaaatctgaagatgtacccatgctcataactgtaataatcttgtccatattcctggccaggatcaattccagactccatggataattcctattgttcaaaaagaaaaattgcatttgaaaacgaattcttatcacgtttcaggtcaaagtcagatttctacacctagaattccatgattctcaaaacattcctgccaaaataactttaaatacaagtgtcagttaaagcaattaaaattactctatttaaaagtgttagtcaaatctattcatttttttctggctgtaaccatttgatacaaaataaggttatataatttgacctgaagaggaaaaagtaatttttttctaatggcaaacctgttaaaacttgcagatgagcattttcacttgtttttggatgtcttttaaaattatcaatcaatagttaatatttaactcaattttaagttaaattattaagtgatgttggccttaagaaaaattataacactatctacagcattttttttcatctccccactaacagttttctagtacccagtattcttctattcattgaaactgttctgataaagtcatctgagaacaagaatttaagttaatgtgtaatgcttcccaaggatgtttatactttaaaacatactgctgattctaaatttaagggttttttgtttgtctgttttgtttttttgagacggagtctcgctgagtcgcccaggctggagtgcagtggcgtgatcttggctcactacaggctctgcctccagggttcatgccattctcctgcctcagcctcccgagtagctggggctacaggcgcccgccaccacgcccgtctaaatttttgtatttttttttttggtagagacggggtttcaccatgttagccaggatgttcttgatctcctgacctcgtgatcagccccaatcggcctcccaaagtgctgggattacaggcgtgagccactgtgcctggcctctaaatttaaggtttttaaaggaaaaaaagaatttgttagaatagaggtccttttaatatttccagttctaaactctaaacatactgattgatttctgtcaaactctacttatagaaagatgtttttcttgagatatacatgtgaaaacggtttctgataactatcaaatgcaatttctctacatttcccttttaaattctactttaacatgttaagcaggttaaatgacaaaggttaaccaaattcatttcgcaatggaatacgagaagagaggggggaaaaggataggtactcacatgaaaatagattggtacatatttctatcatctattatttataaaaatttaattttgttgatccaggaatagtaatgagtcaggaaataaaaagccctcctctgagggcacaaatatgtcatttgcgaagtgtggaaatttacagcctgcatgattgatatggataaagaccctcagttgtgcttggtgtggccaacatcattttaaaaaattgaattcattactaacagtgctaatcagaaaatgacaccaacactgtggatgttggtttctcttgaaaaataaaaagatggaaacactaggatcatatttttacattccaataatctagttggctagattaatttttacagcaagcatgtcctctcctgtttatgacagtatccccaacgacacttttctacattcataccctagtcactatgaaatctgtcatctgctattgctttgtgtctaataaactccattcacttacattactaccctagatcctgtaggtattgacgcttgcattacttcttctatcttataattttgccgtttacaaatactttgtgaacctactctaaaggaatccaattttgatgttaaaactagtatagtttattcaccagaataactaatatttagacaaacccacgatgaacaatactatgtatttgcagggacacagaagagctaaaactctcatctaagtctggagagattattacttggtaaaactttttagaatatgtttggcaatagtactaaattaaatataaccatttcttctttcacagaacttaaatttgtagttaaatacccaacagaaacatgtacacttgtgagaaaacacattattcgtaacagtcccaaattggaaacaatgcaaaagtccatgagataaacacgctaccacatcgcacaacaacataaatgaatctcccaaacagaatgttgagcaatataggtcaggtaccaacgaaatatattatatcattctatttatataaatttcaagaactgactaaagaatatgttacaggccagaaggaaaactgatatctaggtgttgacatagaagagcttgaggggcatgtgcactctgtaaaaattcatctagttatacagtatggtttatacttttcttatgggcgtaggttttatttcaacaaaaatatatttattataggaaggttgaagtgtgggggaaggaatgaggttaagaaagacctggaagaaactgagacaaaaagtctagatttaagttatttcaaactaagtactttgtaaaaacgtttcctggaggtaagctaagaattttagggtatgtaaaactcagtgtaatgacactggtttaaatgaagcaaataggtctcagaactaatattttcaaactgcttgaccaatgcacgtttaattaaatacatacagatactgagaaaataacttcaaacagttttgaagtagacttttaacaacattaggtaatagtaagaaacacgaaataaaaatttcaagtaaatatttatggagaaataatgcaactgagtggattttggattttagaagtcagcatcaaagaattttctttacataaatactttttcttcattaagggaaaataacgctcagctcttgctagctacaatgcatatggcatcaattgcattaaaaatgtaataagaagtatagaagggatgcggataggaacccaggaaactcagcaagatagcccttgattcaatcagtcactctgtatttctgagttgagtaaagagggataggaactagcagaaggaaatgatctaaaaggtccctcttggatgcttccaccacccatgaatgaagagcagagccatcagtcgttaaaaaaaaatttgaggaaagagcccgggtgcggtggctcacgcctgtactcccagcactttgggaggccgaggtgggcggatcacaaggtcgagagacagagaccatcctggccaatatggtgaaaccccgtctctactaaaaatacaaaaattagctgggcatggtggcacacgcctgtaatcccagctactcgggaggctgaggcaggagaatcgcttgaacccaggaggtggaggttgcagtaagccaagattatgccactgcactccagcctggcgatggaacaagaatctgtctcaaaaaaaaaaaaaaaaaaatcgagtaaggaactgctgaccagtcagatccatgagtcaacctcaaccaacaagggaatgctggccctttttgttgttccacacagtcccagtagactgtaacaaccccttagttgatgaattctagattttagaaaagtatgcaaagtaacacactagtgattttcttgggtagatcaaacacttaatgtaatttttaatattcatttttgctgtccacacagggaaaacatagaattaacttaatatttaattattataaacatttatactgatgcaaaacaaaaacaacaacaataattgtaatttactgaatttcttcctgttacattccagttgttgagctaggaacttacacatttattagatattactgctaacattttatagaagatgaaattgatgttcagcagatgtgtatcttgactaaggtcttgcataaagtcattggtgtttggatttcaaccctgagttttccaattcaaattttatggagccctctccatggaaatttttgctaaaaccttataaaagtttaatattcctgccacacaacctccagattttggagagtagattctaaccaagaaatgcctctttttagcaaagacagaattctgtactcaaggaaaaggaataaaatttttgtaagtggagcttatgaaatactaaatttgccgtaaaattaaaagtaggatgtctgtgtttttatttttaattacatatataaacataataagtaaatacaataatatatatttattatacaaaaaatatctttttcacattgcagaagaaaatgccataggcaattggtaatatatgtgtccaaaagaagtattttgaatcacataaaatgatatttaagtacagatatcagcattctgtctttaaactttgcataatctaaatctgatgtcaggaatggatagatgaattcagattgattaagacaagtaactgctgatcgggttcattaattgcttcattcaatgaatggcccgtatttattaggaataatgggcttgtctcattcccagagaatgaggctaaaaatttggaagttgagctaccagcaacttcaggaggtgatttcttggtttcttttttttgaagttattttgaaagactcttttcttttcctttaaaattatgccacattggcagacacccactctgcctacaagaattaatacaatagatcttaaagtcacagtgaaggctcagtgaggttgaaaagaaaatgaaaattgatacctctggtttaagaagagagggcctcagcagttgctgttgctgtcaaaggaaattaaaatagaaaaagatttagaaaataattcagatgggaaaggtagatcatgattgagaagagaggaaaaaaaggcgacagtttaaaacgtgtttccttgggattattcattattcatgtgttagctaccaaaagcattaaatattttaactaattctttatattggaacataaaataagaattcatttgttatgttttaatttcatcattcttctagttaatgacaaatttaatagccttaataaacaggaatctatacagatttttgttttgttaagctccacagtacaaagagttatttatgtttctaaaagtactgtgtgtcatataattacttttatcaagtttaaccttgttttaagttgcccttctttttttccttcccaatcacattaaatgtgataagattcattgggaagaagagcagaacacacaaaacgataaagttgtaatgtatctatcaacatattgaagacatgctctccatttcttcttcttaccaaagtgtggatttcttgcactaaaacattaagtgtgttttcagaatgattaggaaagtcattaattatcagatttggtaggaattgcttcctgcctcttccttctttcacttgtatttatttaaagctaatacagtcaccattgatctgtttcataataatacacactttaaccagataaaaacaagatacacaattcaaattttggggttagtaactctttggagggaaaacagcatattaaactaagtattggaaaagtgggtagtgaggttctgggaggtaattccatcattgaacccactgtttaaactggctagtagaacaaccatttgactgaagggatatcctttttataatacagttgttggtgagttagttattttacttataatgaattctaaactacaatccaattaggtcgtatacttctcttgattgagaagctgtatgctaaatcaaactaggttcgcagtgacttcattggtaacatcacctgcagtacagctggccaaatactactggccagaatgcccagtaagttctctgcagacagaatcaaatgaacacagtagaaaacccagagctttctaacattctgattatttttaaaatctttaggatctcaagctttaacctagtgataggatggcgccttgaactggtaaaaagatcaaaagttaagtagtcctatatatatattctttgttttttttttctttttcttttttttttcttttttttttttttgagacagagtctcacttttgcccaggctggagtgcagtggcctgatcttggctcactgcaatctccgccttgccggttcaagcaattctcctgtctcagcctcccaagtagctgggactacaggcagtaatcctagtttctaaattatatgtatagccttagacaaataaattttggggaaatgtcagaatactgagtaatagtaatgcagaacaaaatacatgtatccttaaaaaggtaagcaagtgatctttgaccattgaataagagatttaaaaccttaaaacagggaagcaacatatataaaagaaaataaatagcataacatactaatatgtttttgctgaaatcaaagaaaataaactagttcaaaagaatgtacattagtcttgcctattacacaagtattttcctagtatgcttgttacgacatcaacaccataaagcccttacctctgatccataacctctcctgcaaggcagaaataaataaatcagtattaaacatcttagattttcgttattaaacaaaatgactgacagataagggctttaaaaaatgtctgagtaaaactgagaagacaatttctactaaacactatctcagtgggaagtatattttgtggaattatcaaaacaggaagatcatggtttcacacctgaattactaaaataatgatcaacccagagcctcgttccatatgagcaacaaaacatgcaaaatctattttatttcaatagtgtataatgacaaactttgactctattattatcaatcaatttggataaaaaatattatacatgatctctgttatacacaagtcttgatatatatactaatccttaggggaagagatatgctttatacatgaagaatgtaataaacataggatgaaaattatgtctatgattgaatatattcttccaaatgattgtatgatattttctttatgttaattctaaaaataatacaaactattggctgtccttgcagggtcaattataatattagaaattaagtgaagaagtttttagagctttaatagccaaatattcaatattacataaagatttataaagttcacacatcacaagatggtgaaacgtttgactatacttgagggggagaaaagaatatagagttttcaaagttgaatgttactaataaataatgaaaatgttctatgtgttattttttaagcagttaaagtgttaaactgatgctgtcaaccatgttatgtagaattaatcaatcagtgtaatgaagaattattacaaagaggcacatattacaaagaggcacatgcataactttctaaaatccaacaaaagaatctctgtagaaaaatttttaaaaaatgttgaggccttcacaaagtaattctacttatcagaaagcatcttgtatggtttatgcattgtatattgaaactgtttgtaaaaaaaagtaaatacaatgcttacttaagcttctcaattgattctttaaaatggttctgcagtgaatttcgtagagtgcttacacggttctgccaatatttataagactgataattcttccagagcctttagaaattgtagacattttcaacttttaccaaatttatatttttcagaaataattcaggtagggaaagctcatatttaggtttaaacaatgacaactgagtcatataccttataaaatatccaaccaaagccaggctttattttttagacgatttcttctgactccttttattagcaatgttttccatcaatgtgaaaaataaaatatcaatagataaactataactcaatgttaatgtttccattcacatttttgttgccttttatttggttatttgtattgcttgtcttggctcaaaggcagaaagttacttgaaagaggtacataacagaactactactttacctgtgtgctttcaaaacatgactattgatacttataaagccagttcatataatatcgatgcacctctttatgcaattcataatcaattgtattatttattttatatcatgtatatgtatcactgtttacttttaacaataaggacaaatgtttggtcatctttcttaagtctttatttaaaaggtatctaataatttcttatgcattaatgagatcataataaatattgagaaaaaagtgttacttttctcctctctggttgtcaggttgtaagcagttagggtttgagaggaggaagaatatttaggcttgtgtactcaaataatactaaaaggtctcatatagaagatattttaactgacttttataatgtatcataatgacattaggaatctccaaatacaatgtgtcagaaaaagactggcttaaatataaaacacaggtatctatgtttcaattaaaaagtacagaataataacaaaactttcagattatgtaaatagtaaaatgttatagaaaaaggcaatataacaatttaatagggctgtaggtacctacacaaatatgttttttggacttctcttatttcttttgttactatttatagatttatcaagaaattataaattttacatttgcaaaaagctggtgtagatattagcttagaaaagacacactcacattaaaggcttacacaattgtgaataccttgtcagagtccgccaaatagcacaagttctcatgcatatgaccagctgccaacaaaaactccaactgaagtttttcagtgaaagaaagaaaaaaatcacgttcaagaaccccaagaaagtaattactcttgatttcgatgaaaagattttgaagcagatgggctaataaaaataatcagatttacagattgttttctgtctgatcttggtaactaggaatgccaggtcaaattattgaagaaatatgagggatgaagaaaacctctgaaataacgcattgaagggggctctcaacttatattcatatacttccaatagtaattatcaggtatgagttttgcctgtattttagaattgtacccttctccatgcaaacttatatcttctaaaatcttaaaactccagagtgttttataagtatttgttttaaacacttacatgtgcattcaaaatgtgaacttccagtaaataaaacctattccatgtgtttcatgggaaaaacaaagtaattacttgatggtcacatattatacattatatactaatattgaaagtatagtttccttaggaaggaagggacatagatagtatctagcttaagtgatgctgttcgaatttaacaattggagcgctaagaactattactacaactacagaaatctcttcccagagtatacagttttattttctttgtttaaaacaaagagcagaaacctaggtaaaagagtgattgatagttcagcaaatatcacttctcttggtttttctatttaagctttttatatttcatttattaaactgaagatcatactttctttaaaaaggaatcttatgaaaaaatttaaattagggagatgattaataatatgaacaaacaaaattaaacagcactttttaagcatctgttggaacaatgaaatgccttacaaaagtcaacgactcaagatttattttcattataaagaagggaagggaaagcacaatgagaaataaagagaataagacagcaactgaaaaagtataagatttatcaaatccataagcatactactaaatccataagcatactactaagataaaagcaagtcagagtaaaagatgttcttatcagaaaacagatgactacatgttatagcacctgagatttattttgaaataccttatgtctgtcatctcctacaatctaggtacattatattttacttcggtagtatttcttcttaccaaatacataggcttcaagaaaaaacagaacctatcaatcatatcagttttaacttatttgtaacagtctgcttttttcttggaacattcatataaaactacgatcaaaaactaaatgtaaatgttactgcatccacatgatagacatgcctttggtttaagttgggtatctaattttcatgcccacatattcccactaaaaaagagattaaaattacttacttttcaaataaatgtagaacaaattatgctactttgtagtttttaaaaagtaaggtaaatctattatatgagtgagttagtagtgatgaggttaatatctttttaaattaaaaacgagaaaaaaaactgcatttcattgaatttggggtaaaataatagagtcttctttgacgttcaaatttgatgttcaacttgaagactatgatcaacaagaggtttgcccgactaaaataagaaaagcaacattacagtgaagtagattgactgtgagattgtttttcagttccctcgacaatattgttcaaactccccttgttttgttcagatgtgatttccatatttgttacttctgaagggcacatagtttgaagttctgaaacatttgtgcgtagatagtttttttctatttgactgtacatgttagctactgatttttcaagttctgctaagtttttaacgtgtctgaggatgccttttggttctctctgagggtctgttttacacactgtcgttgttgatagctgtgtcatagaggacttaattttctcggcaggcatcaagttggtcgtgcatttaacacctgttatacagacacactctgtggacagaaatgaagctgaaggaggtggagggcaaggaatagaaggaggtggtggaggaagaggagttggaaatggaggtagaagaggtggtgttgggggaccagacgttgaaacggaaagtggaaaaaatgtaggaggaggaagaggaagagggatagaaggaggagagggaggaggacaaaaaagagaaaaaggagaaatgtcaggaggaggagcaagaggagcaggagcaggaggaggagaaggaggagaaataggaggaggagggggaaggggacaggcagaaggagagatgtttggtggatgggcaaaattttcaaaaatatttctttcggtttcaataggtaacatacaaataggtgtctctctcctagagagtgaagaatgtaaaacacaaggccttgaaggagaaagttccaaggaacactcagcaggagaactgatgacattaggttctgatttgagttccacagttcttgaaacagttggcaaagtggagaatgagaagtgaggcctgggaaagcaaaatgaagagtctgaagagagagatttcaactgttctgttccttctatcatcagtgtttcaccttgccttatttcctctttctctgtcaaatttgcctcttcagttgtaagcaatggattgctgctacctcttttgtttgtacagattccagtgttttcattttcagctttctgcctggtgccttgccactgctgcagatctatgatctctggtctatttggaactttcctcatcagcctcctgggtaagctgactgactgactccacagcctctgaatcttttctcttgggcccctcagagacttactcttggcttgtattttgggtgaaaatgggtctacaaaatctgttctctgtgaaatgtctgaatttgttgatacttgacttatgttttccttataaaggggattatgggcacttaagtcatcctcatcagatagaaatgtgaattttcttgcagacttcagtttgttgctcttaagtgatccgtctacatgagctgacttgtgagcctcaatagtattggaagaaaagggcatcacaacttgttgatgtttcctgtcttctgagactgagttatttcccctgctttgttgaaaatggtagagaaggaaaagacttgaaagaaaagaagataatgaaatgtaaggaaacaagttgtgacacagctttcatgagaaagatgtttttatggctctcattactattaaatacttaaaaacatcaaaggccaaacaacactaacctactaaagcaagacattattttaattccctgctcttagaaaggcagggcagaaaaatcttagagttgtgagaagaatgagaaatgtaaatgaaaaaaaaagtactcatctctagattattttggaagagagtattttttgtttttgttttttttcagctagtgtgatacagcaaagcatccatgtccacacgtaacagttcccttatgcacaaatcacagttcttcccattgcagaacaccatccttgcctgaggatgctcagggctgcctgttacgcatagaagattcttagctgtatctgattcagtacttctgtcctagagccaaaagtaatctcctctctgagccatcatgtggaatatcctgttctccaaattaagagaattaaaatcaccaaggacagatgggagtttgtctcacagcccaaaaatcacaattgagaaattgaatgtatgctagaattgtgacagaggagtttttcttctgtttaaattttgtgcttaattagttttaaaaccttatacataataccaatcaggaaaaattgttttaaaaccttataaatagtaccaatcagaaaagatgttgtcagtaatttcttagactgatctggatcaaattttacttaaaactcaccttaacaaaaagattgatgctaaaaaaaaaaatcactttttgatatcactgaaaggcttacttatgcacggaaactgaatcataggtagttgtgagtcataaataaagttgcatacatcaaagatcacaaattaaatggctctaaggaaagcatttggacccttctcccaggattgttggctgattgataggtggttccgaattctcattagcttttactctcaagccaaaacagaataacatttattttagttactgcttaatatttacccacttagcaggaatgaaataaaaaagaaatattctgaatagaaattaactagccatattgaaaaattagggtgatagtttaggcaacaaaataataaagccacagttgttaatgtgtcttttggcaaagatacgaactataagaaagagaaagaaacaattcacacaggtagacctggagcatcaagcctacttggacaacaaagaaaattcagacaatctggactaatcagagtgcaaacaaacacttttactcttcgaatcttgaaaagtatttttcaaatatggcacgaacaactgggattgatattatatactggttgtttttgtaaacaaacatttgttcgtggtttgatttctcttggtaaagcacccaatggatataacaatatcacatcactttgactaaaagaaatctataaataggtttctatttatagatttgtaaattttaagttcttaaaatttaagaatttttaaaaactaatttaaaaaaattaaaaacaaggagaattttgaaattcctttcagtaggcacaggtaccatcacagcgaacacatgttttaagctcatgccatcaaaaggaaattgggtgtggaagacaaaactttccttttaacagtaagtgagtctgtggcaaaagatgaagatcactgtatttacagtacaacagcattttaatctgttctattgtatctatttttctaacgctcttctattagagtgatattatttacttacttatgcctatgtatccacaggtgagaaacagaaaacatgtgatagaaaaaaagaagtttttactagagttaatttaaaacaattctgaaaatatgagcaggaacttgctttaaacaaacacttagtacgtatatcaaaaaaaaggcatgtttttatattttgttattattcatatgaatgacatttaatagtagatgaaatcaaatgacattatttgaatgtcttttcacagaaaattgtatctaataaagtctgtttactatacatagataaaaattcacttctattaaacctggatgatgccaatcctaaaataaaaattttaaatgagagtttaaaaattgcttctatgatgtcttaactctgtaaaactggttaatgcacactgacttttaaagtagatatattttgtttggaagaaagtaaatatacaactactatgatgacaattaattacaaagtaattatagcattcataggaagttatcatacgaagttattactttgtgaagtagtttttccaaaatgatctttgactttgttctttttaagataattgataataatcatttaaaactaattcattttctagtaacttaatgcttagaattcctgtaaaaagttcttgaatagatagataggttaaacatttactaaagataagataattaaatatgtagaacttacttaaactatttcaatgaatacatatattacaattgcaaaatctactgagtctactacaattgttcaagtaaaaataatcttaggtattgctatttgaaaattactgtcatcaaactatgctgattccagatgatgttatagtatacctgttcttattaatttaaaatgaatacataattcattaatttcatatataaacacacaactttacacataatccttttttttagtttctaaagatctttgcttgagagaggtcattaacatactcaaatagaatcaaatcatattggctcaattcctacattcaccaataattaattacaaaagaaacaatcatttttcaacttacaaaaaaggtgaaagcatatatctaaagcatgaaccctgtattatgtccttattttggaaatagaatgtcatgctttaacctattataaattcagattttgtgttaaaataatagcattaagatcaattttaacattaatacgactatcctaaacaaaaccttgtataacattattaatatggtaagtaacctgaacacatttgtttaaaaccagcttttccattaccaggtcaatttcatgattttttaggcttttcttattgctactagtaactgatacggatgtcacatgtaataacatgttatagtccttctactccatcaaattccagttaataaaaggttttctggatttaattgtcatattcaaaattgtaaaatattcttggttgttttacatatcatgtccaaaagcagttattcttgaatttttaaaatactgacaaactgaacatcaccataaggaatccaattatgagggtagcatcattatacaagcaactgtgaggtcttttaacagttaccagtgtctttcaaaaatgtatgattttttaaatagtgactacaagtttcaaatcgtgcaggagaaatattcggtaatcaccgcagtctgagagtaataaagtgaaaaaagcattttctaagtagttgggaatttaatatagaaattctgtaatttcattgagattttaatttctatatcatataacgtcctaaaagtagtatctcagaaaatactacgattttaaaccagagaatttggttttgattaccaaatagggatcggtttggatacctaatcaggattactattttatgattgtgctttatttctctcgtctcctatgcaaaaatatatttttcagaatctatttatatatttatacatatatacatatacattatatatatgtaaaaatgcatgaccctgaggattgagatattaaatattatactcaagctataaatgtgcaattgtctcctgaagttgaattctgcttttctcttagctttctttaatttctggtttggttttggctattatttttcaacttaacctttcttagattttcgtcttaacaaattttctcttgaaaataatagaataaaataaatagtccatgtaggcatttccacatcagattgaaattaaatactcaccacacagaattcagtaaaacccaactacttctcagagttcctgaacggtctacttacattgagctgtctccaagttcttcatagagatgcgcacctggcggaggcggcggcggcggcgggggcgctgccactggtgcaggagccggcactgctggtttagccgcgggtaatgcggcctgaattcgtgcagtctttgtacactcagcttgacgtcttggataaagtaaggatggcttgtaaaactcattttagaaatcataatgcttatcaataagccaccttttaataatggggtccagttatcaggggaacccactaaaattattttacacaaacatcaatttataaacagatgtaattacaaaagcatccccacagggtatcatttgcatataatccctgctttgttcttgaaaatagctatctcttgaataaggggtagaattcagcagacatatttgcaaattaaattaaatgataatcttagagaaagcaaaattttaattaaaatgggatggataattaattggtagtttaatgaatctctttcataagatgaggcatattaaagataagatagataatttttctttattatttgtcttttaaagttatttgaaatgatttgaaacatttttgacgttatttcacagaggctgtacacacatgtacaagggaaatttggttagcttgtatatcctttaagattcctaggaatgcctaggccgggcacggtggctcatgcctgtgatcccagctactggggaggctgaggcaggagaatcgcttgaacccgggaggcggaggttgcagtgagcccagatcacgccattgcactccatcctggccaacaagagcaaaaagtccgtctcaaaaaaaaaaaaaaaaaaaaaaaaaaaaaaaaaattcctaggaatgcctgtgattctcatgttacagctacactgctgtttttggatttcctggacactgattaatttcttcctcaaaaccaagatgttacaggatggaagctataggcaaactatctttttcacatttgtgcaagttacgtccaattgtctaaaatcagctcaattctatatatatcaaaccaagaaataaactattacaaacgcaaaacaagggaataagatgtggttctgagcaggctgacttgattgatataatctcgggtttctcttttcctattacatgaaaaggatgtgtaaaatgttaattatacttacactttaaacctgtttgggaaagcaagagtaagaaaaatagaaagctacattagaactattgcattaataacattttaacatctgatttattctaaatcatgaataatttatacgttaaattcataatgacagagttaatgacagactaagaaaactaaggatatcaattcaaaaggtgaaaatagtatcgttaccgttagagtcattcaagccattaaaatatccataacagaaaaataaagaaatgaactacatagaataagaaaactggattaaaatgtaaatgtgagaatttcaactctagtggaaaaatggaatattaaagatgacctgacctttataattggcttcttggtttaccctgcttgaagaatattacaggaatggagagaggtagcaagccctgattatactcttggcttcactttgaagctgaagctacaattggaaggtcctactcttgggtaataaatttatgacagtttttacatatttgctttttagtttccattcatagaaaagttcaaaggcatatcattatataaaaggatagctattcattcttaccttatttgcaagcaaatatcaaggtacaaatgttaggtctttaaatattagaattttactttgctatgtgagcagagaaaaactcattttgtttaattatgttaatctataaaaagcagtaactaaattcatatggtattgagctgattatcaaactaaaggagaattaaataatgcgtctataaattatttaaatattaaacatctcaagtatttgttgtatttcagactaccttgtataacatccagagcgcttcagttttgatcattgcatactgtgccaaatacaagaatttttctcactgatttgcttgctagcaggatataataaagctcctttggaaaatagttaagtgtaaaaagataactggtaatacggaatggatttaacattataattaataatgggttgatggcttaataatttaaaacaatttgttcagtatcaattttgttcatcagctttagatttagcatatcaattgattggttaaggacacattaagctccagtatatcaaccttaatgctgtatttgcaacttcacattgcttttgaggtagaaaatatttctgtagtttcaggttggaattacttgaaaagtaatgacctgcttgaaaaatattaaaggaatggagtcatgcagcaagccctagttatactcttggcctcactttgaaaacggagctagaattggaaggtcctacttctgtgtaacgaattcatgatactttttttcatatttgctttttagtttccattcatagcaaagttcattcagagcatacatttggattttcaggttggaattaccttaccttattcaattcacaagaaaattttaagtatttgagaacaaagatgacagtttaagaatacataaggactattggctgggcgcggtggctcacacctgtaatcccagcactttgggaggctgaggtgggcggatcacgaagttaggagtttgagaccagcctgaccaacatggtgaaaccccgtctctactaaaaatacaaaaattagccaggtgtggtggcgcatgcctgtaatcccagctactcaggaggctgacacaggagaacagcttgaaccttggaggcagaggttgcagtgagctgagatcacaccactgcactccagcctgggcgacagagccagactccgtctccaggaaaaaaaaaaaaaaagtaaagaatacataagaactattttagtatttcctctgtaggtagtttaaatgatgaatagcagttctaccattatttcttattgtttattacataaagtaatttacatgatttattattactgtctgctatttattttctttttgtggcacactcagggctacttctcttcttaatcagctccccaattttttcaagtcattgtctatagaaatatacttaaaatgtgtggctctctatcacaaagcttccccagacctagtgtcaaagaatatattactaacctacttcaaatatggatgtttaaattagtgataattacttgactactctagataagttaaatacaattttaaaatatggatattgtcaatggatgcacttgactgcaggaaccagaaaaattaagagcctgcacagccagaacatgctgtcaaatagtacactaaaaactctggcaaagcacccaggaaggaagaaaccacatagaaaattacatcttacatgctatgattttacaatgcttttgctaacactgtgatcatttgcacaaaggcaaatttaacagtttggataaaaacctatcatgacaatgtcgcgaagttattgaccttcctttggagctgggcagagtgggtatccgcatatgacattccattgcttttaccccaggatacctgttaccttctctcccaagttggctcttaaacaaaagaagagcataaacaaagccacaggaactaaggtgatatttctattgaaagagaccgaattagaatcacaggaatattgggccatcagtgaaaaatgtactgggagtttgtactgttttccttttgaagaaaatcatttggtacgagatagacagacagataaagcaatctcagagtagttgcaccatcaatattttacaacgcaaagccatgttaccagagatggttttctgcaatgacttctgaggaactatccaggtttaccatccttgaatacttactgtctgtagctgaccaaaaccaccaagatggcaggaatgcagcagaggatgatgatgaaggccagagccaacaaggccccttctgtgtatcctagactttctcctctctttttaatgctggtcactgcctctggagtccggatctccagaatgcgtcctccttccccataatacggctgaaagtctttattgatatcaagtagtttgccatccaaaaatctttattgttagataaatagtaaaattaatgatgctagcagagaaagagcattttaaaaataaaatctttttgtaagatctttcaatattttctctaattgaaacacaagctgagtcagaagtctcatgaataataagaaaagcatatataaaaagcataagcaataaagaagaggagtaattacacatctgtatagaaatatcaaaaatattttaaaacacagctcttgatctgcttatagacttaaaaaatctaattatcagtatcattaagcttaatattactgtgtcaaaataatttaacaacattttagatggaataaaatataatatcctaaattatataccatagtttatatttatgcattttatctccttgggtcctgtaaccttcaggataaccctgtaaagatcaaacattacaatactgatttattgcaggccaaaaagctatacagttataaaaacaaatctgaggcaccaaactaagatttcagactcaaactctgtatttgtttgccataacaccatcttaaaagtaaacattctcaagtttcaaaccaaaagaatgttttatggtcaaatggtgaagacatttaaaagacccttctgcctaggaaaaaaagactaaataaatgatgcgagtagtatatcagtgttgtaagaatgacaggaagtggtagtcaatgtaattccttcctctaaataatgcaattccaactatgagtcttgaattttggaagagaatcaaggaataattattcctaatcttatgagattgaaaaaatttgttatgtatttaatatcataattagcaggtgattttttaaacaattccttgggaacttttgaacagtcccttataagctctacatattgatgcagcaactgtgttcttaatacaacaacaccataaaggtcaaacgtcttactatagaatattggaaaacaaaaatagttcaagaaaaacacaattactcatagtcccatgatctacagacagtcataatcacttctaacatcttggtatatttaagtctaatatttttttggaggggtgatattaaatattttatatacttgagtatactgcatatataaagtgcttatgttgaaaaatacagaaaacacaaaaaaatgcaaaagaaaaaattaaaatggccctaaatttcattatcaaaatataatcaatgccatgcttgtgtacttttttcagtctattttatgcccttttgagacatttaattttaatattcagagtgaccatgctgattttaaatcccgttaacacactgttcattgcttaaaaatagaagtgcctggtatcacatatgaattccatcacatatgtaactcataaactaattcatatcacacatgtggcaattagaatgcttttttgctttttttaaacagatacgcttttatagattaaaaatgtactttttatagcaattttccaagctcattgttacacgttaaaagaaaataaaaatttagccatttttatgattactagaaatagaatagtgaaacttcttgtttgaattgtttattagataaaggaagagattctaaatgatgcatagatcaagaattgcttcacaggaactatattattagaacaaggaagaatcagatccagaagaggatcattaatttaagggaagaatatacccctacaatgtggagttcagttgacagatcaaaattctattggattcctggatttcatatccaaactctctaaagtaagatttgttagtctttttacactgcaagagccctattacttagatacttattttcacttatcaatgtgatgtcataaacaattttttactagaaggatggatcacttttgaacccacacctgatctagactatctttctttactttgtgtatttaaaacaacttgtctgggtaaaaattcttgagtcataacattatcccttacaaaacagcaaaattgcttccattgccttttgtcattttatcatgcaaatgagatatgcagggcttacctaatttttgttcctttatgagtaagatatttttatttctgtttcagtgatttttaaacatattcagatactattcaaagaaacatggctaccttttcattgatttttgcctgtaatataataaactcttgaattcttttttcgattttttgcttctgttataaatactacaattttaacctcagaaataactgtcattatcaggttgtattttaatcgtcctataaatatattttgatctcttttattatttatatgttttttcctttttcttaatattgcataaattttcaatggatacacttcatgttgtcaatttaattttcacatgccttctcatttcaggaaaggttgaatccaggtgctcaattgattttaggagataaaatttaatttataaattaggcacagtaagatattaacaacaataactaataacaaaatagaacaattatagaactatagtgtaataaaagttatgcaaatgtggtttctctctgtctctgtcaatatcttattgtattgtaccattggtaactgaaactgaagaaagcaaaaccacagaagagggttgactgctatactccagttggactgaggggaaggcactttagattaaagactaccaccgtgtaggaaagggacaattctcacgagagaaagtggaattcttttaccagaaacaggagaaggactcaagccatgtaaaacacacacaccatttcaccaatccataccattctgttttctactaaaaatgttaaactgttttccaatggtttctgtaggagaaaatttccagagttatatattctccctctgggtcatcaggttattatctcctgattttccatatttattttgttttttagtatttattgctgatcccgtttttccactgcttacttatcctaaaaaagagatagatctgcccaaatccagcatcaacacagaaatgtgttttttttttttttctcgtcattttcatctacagtgtactcagttactatatgcaaaccttttgtaattctaagggaagggtatacaggtcccttcccaggatgtagccaacatgaattgattactgctatgttatcctgaaatgagataagttgctaaaccaatgtcatgtcttattattttctcaagcacatgcaaacatgtatttctgcctccattgatggatatggggcctaatgttgtgttattcagcatataattaataaatacataatcaacaatctaccctgcatctcaccttcgtgactgattaccttgatgatgatgattttgatactgcaatgtacatatgaatgtagaaataagtaaagggtgagcaggagattgtactctagacagtagagggacaactgtctatttcctttgtaggtacacaatttaggcgtacagagtgggcagtggttaacatatctacctacattcattacactgtataagatttttctgcttaatcaagcaaatcatggttagatcatcaactattttcttttcacagtttcataactgtttaactagattctaataattagtattccattgatttggattttcagtattttgaatttatatgtatagttttttacttagaacattgaaagaggctttatcagagcctgttaatcagataccgtttaaggtctaagtgtgtttttaaacattgtggtttaaaggcagtgtataaagtctttttctgccttctccatctttctcttacgatttggacatactgtttttaaataggctggatataagacagataaacaagctaaaatgtatttgcttatttttaaattttaattaaactatattttaaagtagtgtgttctgttttgtgtagaatgcagaaagccacaagagaatatggctattaacagcaacaacaaaatgacaaaaaagtgccaggttatactaaaatcataaatttccttgagctgaagtcacaatgtgagcaaaaaaaaccaaattccattgagtgacaattaggataatttcatggtgagatgtgaccatacattgtttcacctttggcagaaaaggttaaaagtggctgccataggctgggcacggtggcttatgcctgtaatctcaacacattgggaggctgaggtgggatgattacttgagctcaggagtttgacagcagcctgggcaataaagtgagaccatgtctctacaaaaaacaaaacaaaacaaaacagctaaaattgtaataaataaggttagaattatagacacccacaaacacaaggggagtctcccctcatttgaaaacttctttgcgtagatttctgtaagatagattgggggacaaggcaggacacaagagaatattccttcatggtgtaagaataggaacaaatcagcaaggctggtgcacaggcagcaacccttgtgcaattccccagacctttatctcagatgaaacaagggccgtaagtattagagggaggaggaggaagtgtgcccatccctggtgctcaggcaaaggtctactgcttctggaaaagaggtataagcaaaaatcccctacccctgggggaggagcaggaagtcctctcaggtgtaagatcttgcaccaatacaaagtagaggtctactatggattgagaaggggcagaaaattctcttgcacccaagaccccctgtaaatgtgaagcagaggatggctgccatgatgccataagaaagagggggaaaaaatcttgagaaagcccataccaaggcttacacatgcaggctgtacaaggagaacagaggaacccctattccatgacccacctcttccttataagagtggaacccagcagcaaggaggagcagtctaacactgtgggacagatcagagtgtgggcagaaacctcttctgtggcacaagcatatagagagcactgagagctgaggactgagtaagaagactgagaaaaccctacagcacgcaggcctctattctaagactgagttgacaccattccaccaataaaagaatttttgaagcttttggcacagtggaagtaataattgcaacagcaaaatccaaataattcctgaatagctttacttaacagagtaaatgtctgtaatgtccatttacaggcataaactctatttacctcacttcttactgttcttccacaccatgtctggcattcaatcaagtaggacacaaaaagcctacaaaatataaaacaaccattttcaagaaatgaagtaacagagccagatagagataacccagatattggaactgtcagacaggaactctgattcaactctgattaatacattgcaaaatagcagaaagcacaaacatgcctgaagcgatggagaaattcagtagagtggtggaaataagaaataatctaatagaaatgctagaaatatctttctaaaaagataaaaagatgaagaatttcttcagtgagttcatcaataggctaacacagatgaatcagtgaattcaaaaatagggcagtaaatattattcacactaaaatacaaagaaaaaactgtgtgtctatgtgggcgggggaggggagcagagtcagaacggaacaaaattatgagaaaaatcaaattgtaattggaatcccagaaaaggaataaagagaaaatgggcataagaaatattagaaaaaatgtctgagaatattccagaaataaaaaaagaaaaaactcaaaatcaaactcacaaaaaaatgcagctccaaagagttgagaactacaaggataaaaaagcaggataagagtaatatataattattgcataaaatctaagcaattcaggtaaccaaaaataaaaaaattaaaataccgataagctggccaaacaaaataagttattaacatatcactaaaagtcattccagtcctgtctatgcatttatgagcttttttatttttgattgccaaaatatattttttcaaatcaaagtaagttcccaggacaaattattattatgatgatttctaatcctttgacctgagcattccaacatcctcagaagcttagattttaaggtgaaaggaaattgaaagaacacttccattgacctggaccggcatcttaatgttctagtacatttatgcagtgttaaaaactaaataaccaataactctcacaactacagaatagataccaatacttgggcactggcattatcagccttggaaaacacacacacacacacacatacacacatatacacatgtatatgtatgtgtatacaattttattataaaatctttcaagaaacaattctagagtttcaaatagaccagtgactctaagcttactataatacttcaaggtgaagactgctaaggcaaaattttcatatttcatggctattctatcttttcttcaatataaacatatattatttatttatttatttatttatttatttatttatttagaggcagagtcttgctctcttgcccaggatggagtgcagtggcatgatcttgctcactgcatgctcggcctcctgggttcacgccattctcctgcctcagcctcccaagtggctgggactacaggtgcccgccaccatgcccggctaattttttgtatttttagtagagacggggtttcaccgtgttagccaggatggtctcgatctcctgacctcgtgatccacccacctcggcctcccaaagtgctgggattacaggcgtgagctaccgcgcccggccaaaaatttattttatgatttatatatattctgttttttccttgcctgctggctatgatagttattttattgaatttagatgtttactgtccataatataatttaggtttggaaaaacttatttagaattaattaaagatgttcatcttgtatttcatggtgtcacttaaaacccaagtggcttttttttccccaaatatttaatctctagaaggtttgctagttaaattcaaattctaatcaccattattttactctttaaagttagcccaaatataatacatatttttatattcaggtaaaaacaccctaaactcaatcaatcgtgaaatttaaaaacaaaactaatgtatgcaaaaaacacagaatgcaggtagattcacataaaaaagaaatgtgttgattttctgacaatcgaaagaatatatatgaattactttggaagtttattcctaaactttttaaattaataaactttttaaattaataaaacttacaaaaaattggcttggtagatctaaatgttgcttcattttggtggtgactataaaatcagagtgcgagctattacttcattcatctatatttcctccacggttagtatcctgttttgcacatggcccaaatatctattaaaaatgaattgatgagccaggcacggtggctcacacctgtaatcccagcactttgggatgccaaggcgggcggatcaccaggtaaggagatcgagaccatcctggctaacatggtaaaaccccgtctctactaaaaatacaaaaaattagctgggcgtggtggcgggcgcctgtagtcctagcttctcaggaggctgaggcaggagaatggcgtgaacccgggaggtggagcttgcagtgagcgagattgcgccactgcactccagcctggggcacagagtgagtctccgtctcaaaaaaaaaaaaaaaaaaaaagaattgatgagtaacatgttaaataattatggcttttaaaaaattttagctgatattaaatcattattttattattgccaaaatagaagtgatgaaattttgtcgatgaacacatttaaaataaaactaaattcagaatttattaatttgaataaaaattgaatagatatttacaaaataaataaatttacatacacataatatagatatatttgtaaatgtgtatatggatatgtttatatgctgtttaaaaagtatagacaaagaaaaactaaattatgatgtttcacatatagagttcggcatgactatatatacaggcacatataaactattatgattgtatatcaatatatatttttaactaaaaatgtttcattgagatagaatttcattacaagacccagttggacactaggtgtcaccagagtaaagaaaattctgttaacaatttttttttttttaagtatttaagtgtgctcgaataacatccaaagaaagtaagtagcaggattttctttaagattctgcactttatttatttttaggatttataactcaaatttttaagttcctgctaggatgaaatttcacatagagcatgaacttaaatgggaatgattatcccacctgctctccacctgtaagttaaagaaaaaagcagatattgatttttgctgatttagtagacctgtaagaaaggtggatttcttcttaaaatgcaagcatatgaaaatcattgcagaaaaactgcctctttaagaatctgtgctttcctcattaatagccagtgcccttgagcaagagtgaggagctggcagcaggtgatttcaaggagctgttccttgttcttaagtacaaaaggtcatctgatgcccataaagaaaatgggccctctgaagtcactgtagcccacacttagacctgaaaactttaaggcatgagaatcctaggtatttcaggttctttgcttacacttcactttcagtaactatttggtgggttttaaactttaagtacttatagcctcaagtcagaatcatctatggttgctattgtaaccaaagagctgttacagataacaaaaagcacttacttaaaaagctcatttctatcgatggctctgttggtttgggggtcaattgcatagacagtcaagtcacatttggtgtaatcttctagggaaaaggcatctccatgccggcgagctccaatggactccactacgaccttggcaccaggaatttgttcctgaacatagcgatccaagatcctataaatcaaacaaagtacaaacatgacagtccaatgggctttctgggagtaaaaaattactcttaacttgaaaagacatttagtaaatgaaaaatgatgacagcctagttttttgttaatgtttactgaatataaacccttgaaaaacattctctatattttttcagcatttagctcccaatgatgctagaagctgaatacggtagaaaaggtcaccaaccatgtcctatttaactttaggctttttgaatttatgatactatttgagcttttacatgagaaatgccaaatatgctgtacaaataaagctgtctatgctttataggaggcatggggtcttagaacccttgacttcacatggttggtgtcataaattacatctcccactaaagtctgtgacacatgacacgtagctatatgctaagaagcaggactaggatgcctgttttcccaaaggtataaaaatccttgcagaatcacagcaacgggagaatgtggagatattttgcaatggcaggattaccacgttaagataaaaatatggcatgcaaatctcagacactatttaggtgaataaaaacaacatataccatctggtataaattagtgatatttaatttaaaaagcagagacaatattaatcaataagtaattttcccatctcatgactggattttaattgaaagtatgaattattaccatttcccaaatgtctcattccttattaaaaactttatattattaacccaagtatataaatattaagagcatataattcagtatttacagatgtttaaatttaaataattttaattactatatatgataaatattctaaaattcgtagactcaatgctcttttctgagtctatattttgaggtttttttagggggagaagggcaatatattctaaagtcctttgatacatcagaaaataacttttgcttctaatgccacaattgacatatttcttgctcgactgaaagtatattcccttaagagtcttgtatgtgcttggtttgccttgttattagaacaatgaggttactaaactttggaggaaatggctctaccagtgcatgccaggagacactaccaatcatagtgaaatgtttgcttgcttgtttttaaatgtttgtaacccagtactgttgaagtctgtcttattgaagtactattcattattttccttttctgtcaccactccacgcccactggtctctcggcttcgcaatttcttttctgatgacatccttgaagtagactaagaaaagatgatgtgtaaaaaaggaggaggagcaaattcacttggaaaatatcagttaatagttgaatgcctgcaattccagctagtcgggagatgaaacagaagaatcgcttgaacccgggaggtggaggttgcagtgactccagcctgggcgacagagcaagattttatctccaaagggaaaaaaaaaaaaaaaaaacaaccccgggaacctgaagataatggatgtactgagagacacagactagtctaacatcatttggactgtgtttttcagattttttttcctgagagatttatgctcatttaacaaaaataagagaggcctcggagtcaaaccatattatactcttgacattttgtaggaggcacaaacaataatgatataatgttgaggagtacagatgtctggctggcttcaattttaatttcctttgcctttcaattgcataaccttagacaagtaatcttaagctctcaaagtctcaggtttgtttgtttgctttttgagatggagtctcattctgtcgcccaggctggagtgcaatggggcaatctcggctcactgcaacctccacctcccgggttcaagggattctcctgtctcacgcctggattacaggcatgcaccaccacacctggctaatttttgtattttttagtagagacagtgtttcaccatgttggtcaggctggtctcaaattcctgacctcaagtgatccgcccgcctcggcctttcaaagtgctgggattacaggcatgagcatcacatctggccatgtttccttaaatagaaaacaaggaaataatgtaccacatggggctgaatgtgcattcggtgaaataaagcttttacacagttcctagcacatagtaactattcaacaaaatgaatcttatttttattaatttgactgaaatatttccattaataagcttcttccttgtctcaaattcattcaaggcctttaattaatttgtggaataggaaagtatacttctcactagtataatcaatcagttcacaaatcaaaacgcaaacaggagtacctagttaaatacaatgcaatagatggctctctgtcccaatactttggtctaacaatttatgccttctccagtgcattttggcattgatttgacatgttccaaggaaatccttcatataagcatagattaattgtgtgtgatcctacagtgaagaaacatatctattgtgcttgggttcttttctattttcagtgcaatactgcagaatcatttcactaaaaaaaatagatgtggaataaaatataactgtaccaattccttcatggtagcagggaatcatgaataaaagaagtctaaaaacaaattatgtcatttaaaacatgcaataatgtcttcactttgagcatttttttgttaaacttttaaagatcttttgggacaaagtatatcttatgataaaaagagatatagcctaatcttaactgcttctgtatctttttcttataaatgtaagtaaaactaaataccttttaattgagaacacatttcataaaaatctatcttttcatttatcatctatatctatatactaagtattttctacatctatattcattacctatatgtatataaatttcctcacatatatacatatacccccacacacacaaagaaaaagagatttgcaatgatgtttatctaacccataatatttgtatcatacacacacatatcaagaaagatgtccataatgatgtttatgtaatgttaataatgcttagagctggatggtatgattttgagtttaccttttataactttcttcttcatatattatattgcttatatttctttataatgggaataaaagaacaatatagttatatttttaaaaaatctccttaactccctatttcctctccccaacttcgtgataaaaaaagtcttcatataaatctatattttctagtttaaaaatgaaaaaaattaaattggattcagggcttttcataaaattatagcaaaactcactcagggaagtgttaagtaggaaaattttcatttattcattccttcaacagatgtttattcaatgcctatcctgggccagaagccattccagacacatggaatacatcagtgaacaaaatacaatctttgatgtcaaagaagaatttacattcaaattgaacaagacaagtaacagatcatggattgataaaattggtaaaagtgttcagaataaatatcattgagactttgatatttgagcaaaaactttagggaacaatgtgtgctgtggctattctaggaatgagtgttctaagaaaagagaattgctaactgcttgtataaatgtgctgatgtagtagtgtgtggccagagcagatcacgtggggactttgaggattgtaagagcattgttttttgttctgagtgagataagaatctgttgctggttttgaatactaaagtaatatgatctaccttacatttaaaggaggcacactggttgctgtgttgagactaggctgagtagaatcaggaaaactagttagtaaagaacttaagtacatgaaggttcattaaatgctcagcctactcaataatttagaagaaaagacacaacccaatccatgactattagccatatgaaataaaatataaatatcagagcagatataagcaaaactttgaccaaaaagaaaacacaaaaaatcaagaaacagaaaatttgcttttttggaaaaaacatgatatgaccataaaaacagacacgtacaccaatgaaacagaagagaaaactccaaaataaatccacactcttacagccaatcatttttgaccaagatgtgaagaacatacactggggaaaggacaatttttaatgtatgatgataagaaactggatatccatattcagaaaaataaaaatagattcccatctttttctatgtacaaaaatccactcaaaatggattaaaagcttaaacataagacataaaactgtaaaactactagtagaaaatattgggaagagacttcaggacattggtgtgagcaaagattttgtaagactccaaagaaatataaattttccaatgaaagcaaaaataggcaaatgggattacattaggcagaaaagcttttacacagcaaatgaaacaattgtcaaagagacaacctatagaataagagaaaatatttgcaaactatccaatcaacaagagattaataaccagaatatataaggaactcaacagataaaaaccaaataatccaatttaaaaatgggccaaggatctgaatagacaattctcaaaagaagatatacaaagagtcaataggcatatgaaaaaatgctcgacatcactaatcatcaaggcaatgaaaatcaaaatcacaatgaaatattatctcatcccaactgtaattgctattgtcaaaaaacaaacaaacaaaaaataacaaatgctgtaaggatatggagaaggaggaacatttatacattcttggggggaatgtaaaatagtacagccattatggaaaacagtatggaggttcctcaaaaaactaaaaatagaactataacatgattcagtaatcccactgctaggtatacatccaaaagaaagaaaatcaatatattgaagagttatctgcatgcctatgtttatcacagcactattcacagtagtcaagatatggaatcaaccaaaatgtttatcaacagatgagtggataaagcaaatacagtatatatatacaatcaaatattatttagccataaaaagaacaaaatcctgtcatttgcagaaacatggaagaaactgaaggttattatgtaaagtggaataagccaggcaaagaagaaatatcacatattctcattcatatgtgggagctaaaaaatggatctcatggaggtagagagtagaatggtgcttaccagaggctgagaggggaagaaagatggggataatgataaaatggttaatggatacaaaaatacagatagagaaaataaataagttatagtattcaacagtacggtagggaatttatagttaaaaataatgtgttgtatatttcaaaacagctagataagaagaattgtaatggtcccaatacaaagaaaaatattggagttgatggatattccaattatgctgatttatcagtacacattatatatatatgaatccaaatatcacatatatcccaaaaatatgtacaactaggttatatcaatagtgtatgtgtatacacacacacacacacacacacacacaaacaaaaaaagaattaaaaaatgaatgccaaaaatttccctgaatctgacttcttggtagcaatatacgtatttaaaatgcaaatagtacaatcaagtatgaagcaaaacagtatctgattatgtcgagcattctcaaaacagagaactggctgtgattggtcttctaaaaagtgaaaaatatgttaataaatttggatgataattacaattattgaataaaaattacattttaaggctatattgttccactttactttgaatgctctctaacatactcctgttaatgtctatttaattatgtcacctttaggaaaagttttaaaaacagaaaacttctaaagaaatacgttaatatagctaatacaaacattttatgtaacatatgttagtatagtaccacatactaattaatgtccaatacaaaacagtttatctaaataaccttcttagaataaatgctgaaaggtttatttaactgattttttttcctatgcagatagcattattttaaaatcacaaactaagggtgtcaataaacaattggttcgcttaacttacttattcttgaaccaagttatttttggtagatgctctaaatttcaatttacagcattaccttatccagttacctgtatatacatcttcaattagtttcaactagaaattgcattatgaaaaactgtagtgtaaggtgtttactgatagttttatagctgggacaggtatttactcatggttgatttagctttttatttatttttttacactaaaattattacagcagccataatctcaattacccatttgtctgtgtgaatgagttgagttaaaattaccatgtgatgagaatttctggttttgcatgctcagtttactcccaagaaaagatgggttgggtttttaattaggtttgcctcctaagaggcagtgtaacagaggaaactccatctgctggtggctggtagacgtagattaaaattaaacctccattattgtgtctttgtggaaattacttaacttttcaaagtttcagggaatttatctgtacagtgggaaaagtagtcaaacctacctcaaaggtcctctgtgataggttaaggagactacacccattaaatgcacaaaaatctaaccaatatgaagcgtgtcataaatgttggctacctgttgtgatggttacaagaactcttcagatttcatgattataaaccctacttaggcttttgttgaggtaaatggcttatatttatctagcatcatagagagttccaccccaagtgcttatcaatatttttacacaagcttagctaaattaatcaataggcattgcagctggctggagggataaaaatacaggcatacagttcctactgttctgaacttctttcctccattaatacagacccacagggactctacccagaccatatcctaagtagtgctctagatgccatggagcattttgttcattacattacatggtaacctctctgtggtatcccacaagataaaaatattttcctctaatctggaattagactttgaaagagttcttttgtcccagaagagatatggttttgttaattttgtaactgagtctgttctttttgtttagcttgtttgcttctttcactttggccctaacaaggtgacagtcaagtttgtgactactctatatggactatacaggcctttgcagcatctctgtaattacttactcttactctgatcctttctttaacttctttctcatctgtttgctttatttttctacactcatttttaatgtattttacctttttttctgtgtgaatcattgtaaactacttctgtttttctttggaataaggtagaaaattaaaacaaaattaaatttagcctttaatatttattagacatatatggaagcatctaaaatataatttatgactttctgatacaaacggaattctcttgcataaacattttgtggagtttatgtctcacattaaaaaacagcagtacagactgcggtaaattgtgaataaattgaagaaagtatagaaaagaataataaataggattaagagaacagaggaattgactcttgatgattaaagtggcctctaaaggaagtgatatatctaccttgtaccatgagttggggtgaattacaaaaataacaagctgttcaatttgacaaaacttctaggttataaaaaaaaaaagaggaggaagagaggaaataattttaaaagaaataaatgtccactatgtattttagagatctccataaagcaactgtgattcaaatgttttgataaaataatatataatgatgtccttatttttacactacaactattttctagttattttctacttggtacaagcaaaagatcttaaaaataaactgaactgaatgatatttgaggggagaaaaacagattataatacaagttaagattaaccgctcaatctttctttgcttttcttcctaatttctagatcttaaaataaaaacataaataaagttgtctggaaatgtttttttccttagtgttttataagtgaatttcacttttgaacatgaataaccccttaccttcaaatctcaggaaaaaatatacctgtatcaattattttttctccatcataagttgataagaacattttaaacactttaaaattttgaagcacaattcaaagattcagttaatatacgggtaccttcattacgatgattcattgtgcattaattaattttatttctttaatgtatctttcgatcatgctattttcttaaacaaaatagtttccccaaaattttgtttgtattattttcatagtgcaaataaaggcaacataaacatatttatctttgatttaaaactaaacacatagtgtttttaattgatcttccaataaaatatatttttaatctgggaagatctcatttatctctttttgaaaacaacaatagctcaaagattttaaacttttttcacctaaaagcaaaatgaaaatgtcctcaatgttcatttatttgtttgtttgttttggctttccattgtctccaaaagtttgaatactaaaaaagtaaaaaagataaaaagtagaaagaatattgattctgacaaaatacaccacctaaatgtagcagccctgcctcattctttagtttttaatctttttttttctatgttgctgagaaggcatggagaaagtgtgcaaatatgatttcttttttttatattacatctctcagatggcaagtgttaactaagaaagttgatttattttgtatatgtatatatattttttccaaacagaagctgttataatagactataagcattcagaaatgtgttaatgaatgaatgaatgacgaccattaaaataagaaacatatctatctgaagcaaacatgtcagcatacaggaccctttacggaatcaatatgcaatggaatcttaagaaaaaaagtaaaacctacttgataagtgatttgcttttggttaactttgcttatagaaaaatatgtacaaattggccggacgcggtggctcatgcctgtaatcccagcactttgggaggctgaggcaggcggatcacaaggtcaggagatctagaccattgtggctaacacggtgaaacctcgtctctactaaaaatataaaaaattagccgggcatggtggcgggcacctgtagtcccagcaattcaggaggctgaggcagaatgacatgaacccgggagacggagcttgcagtgagccgagatcgcgccactgcactccagcctgtgcgacagaggaaggctccgtctcaaaaaaaaaaaaaaaaaaaaaaagaaagaaagaaaaatttgtacaaatttggaaaatccaagtcatacaaaataaaaaaaagcttaccttaatatacgtgaaatatattatcagagacaaaacactaattattgtgactttgagccatgtgacagatgattaatccttaaagtaaacaatttactcatattgggctaagataacattcctccaaataataactaagaatccacgtaaaataaaaccttttaactctcaaaaatagaacagaactgaaaatcatggagcaccttagtttataatcatctttgttccatgtgattatttcaatactaaagttttggaaacaattaaaaatcctgccatatttaactaaaaacagaattttaaatctgtgctttttctacatttcaaagagttaagcattaaagatgctactgcaatgtgcacaaggattattataaaatagtagcttttaattgtataattgcatattggggtatcttcagttctgtaaagaactatgatttctttaatcataattaacctaatgagttaaagacaagtcattcttcttgtaaacagaggttacttctctactaaataatgctccaaatgaatatttcaaaaagtagcaaataaattttctttctgtcaaaacaatgaatttccaaggctttgaataaagcttagtcacacttaacctttttttaaagaatagtaaattataccttgaataataaatggtaggatttattattatatttctggtttgtattttatttttatgattgcttttagtttattttatagctattacattcctattacagaaacattattttcaaaaattgtactattaaaatgggtgtgctgcattatctgataaaaattaaatcattcatggcaattctctgttgataatatcttcaactccaactatatctttatgctaagtatgctgagagaaaattggcatgtaatagacaatacagcaatttaattgtagaatatggcagctagggagaagactacataacaaaagaaactcttaaggtatctagtggctaccatattgaacagatgggtctaactaaggactttccatctcacacagaataaaacttgaaatcgtccaagtgatctatcaggtcctagaactgattttctaccatgatatctatattttaataagccaagcatggctctttctctgggttttcataactgcagttctctatcaggaattgtgcctcttcctctctcatagtcaaacgactttttccatcacttaatatagatgtcttctcagatttcaacttatcagaaaggctttctttaaccatcctatttaaaacagcacctctcttccaaaattttctacttgatacttgtatttatctgtctttattacagttatcactacataacttaatattacatatttattaatattgttattttatatgccatttttatgcaatcgaatagaagctccatggcagcagggacttcacactgttcactgataatctccagtgcttacaatctgtaactatttattttttaactaataaatccccagctctaagatacaaatgcaaaaactcaaagagtttgatagactggcccaagacttcctagctagtctttggtggtctgggaaatgagcctaggttctctgaaacaaaaaggagctcaaactttccccttaaaaccaagtttttattacattgatttaagaaaatgtgctagcagttagcgtttcataggtatgcttcccgagagaccttctaattatcctcctagaaatatatatatatatatatatatatatatatatatatatatatatatatatatttacacacacacatatatacatatatactatacaaataaataaattctatatacgtaatatatatcctggctacatttctaatgtaggttttgtaaccttaattctaggaactatagattgattacacagcacatttcaggtgctacataaatatttcataaagttgaggctcttcctcatcaagtcagtaactacttcagtaaagctctactataattgaattttcatattttattcagaaggtaagagatgggtttgagcaactctgagaaataagttgtcagttccgattcatacaaaaatactctaactcagtgtttctaaactcgagtttataattttcaaaatatctcttttatagatgcttaaggatttaaattttagaaccacagattcctcttatttgagtttcatggtgaactgggagtagaaagaagttataaaatgcaaacatttcatagtttcttctttagacaattatttgccaattatttgtccattgtagttacgtgtccctactgttattctcacagctgtttctcctataccttaatttaaaaaaaagtaatttaaaaaaccacaagccttacaaagaggtgaattctaagatcaacttaaaatacgtcagagcacagatattcaagggtatctgtagtggatgcagatcctcactggaatttgttgaatatattaatctaattaaaaaggtatatgtttccttacttaggggaattggtcaattttataagcttaaaatctaaaaagtagtaaaaaattttcagtatagtcatttcagctgattcagtgaggtgaggagtaatcattacagcagctaagatttattacaagcattccattttccaggtactgcggtcttagctatcaaagtgtactgatctttgtaaaatctgctccattgtaaaatggatatgtcaggtcattatttttcctttcatcaagtgtcctcatttgtactgattacatacttaccaaggaaactttatatttttgcctaaaatattggtctaccaaaaaaaaaaatgatcacatgacattccagttttccacttcatcggatagggatgtctcaagggaaatatagaaatggctttgatgataactaacttgtcacctaagaatgtcacagggaattaatgtgtttactggtctcgtcactagaacaataaattcttctatttaattaactatttggcaccccgatggctacctgagttatgtgtgtattttcatcactcatcccagacatggatagggggagcactggggcttcacagtgctgactcaggtcttacagttcttatcactaccacttccatctactaatgtaggtttcaaaaagagatcagaaatatttctgcttaagaaaactctaaatttacataggttttaaaaaaaatctacaaaatgaaatcagacatggaagggacaatttcttaaacaactagtattgaaaaaatggaatatccatatgtaaaaaaaaaaaggctggacccttatcttacaccatatacaaaaattaactcaaaatggattaaagatctaaatataagacctccaaaccataaaatgcctagaataaaacgtatgagaggtgttttgtaacactggatttgacaacgatttattgaatatgacaccaatagcacaggaaacaaaagcaaaaatagacagatggactacctctgactttaaaactttttgcccaattagtgacacaatcatcagggtgaaaaggcaacctatggaataggagaaaatatttgcaaatcttacatctgataagggattagtatctaatatctaaacaactcctacaactaaacaactaaaataaatcaagtaacccaattaaaaatgtgcaaaggacttgaatagacatgttttaaaagatgatatacaatggccaatagcacctgaaaagatgctcatcatcaataaccatcagagaaatcaaatcaaatgacaatgatatatcatctcacacattagtatggctactacgtataaaaaaggaaaaagaaccagaaaataaaaagtgttgataggaggttgagaagttggaaagcttatgcactggtggtgaaattgtaaaatggtgcaactgctatagaaaacaattttctttaaattagaactaccatatgatttagcaatcccacttctgagaatgcactcaaaagaatgaaagcaggatataaaagatatattttaatatttatgttcatagcagtattattcacaatatccaagagggggaaacaacccaaatgtctattgagaggtgaacagatgaacagaatgtggtatgtattgagaactattcagctctataaaggaatgaaattctatcacatgctaagctgtaacatggatgaatcatgggaatatcatgctaagtgaaataatccaatcacaaaatgagaaatactgcaaatttccacttttatgatgtatttaaagtagtaaaatttatacatgtaggaagacaaaaggttgttacccagagtctaggggtaaggctggaatggaaacttgtttaatgggtaccaaatttcagttgtgcaaaatgaagaagttctgaaaatctattttgaaacaatgtcaatatacttaaaactaccaaactgtacacttaaaaatgtttaagatggtaatgtttatactatgttttttaatcacaacaaaaggaatggggcatgtatgtgctgcttaataaactcgcagatttatatttaattcttttaaaatcaacatgagatagaggtctttattccaattttcatgaagaataaaagtggctctaggtgctaagtagcttgtccagaggttacagagctgtaataggatctaaatctctgtgtctgaaaccataatctgcattccattaccaaatgcttaataaataaaatgtacaaaactcctagccactctccacctaagtctactgactttgagctgctagctccatttatatggaatatttaccattcaccgaatagtcatactttctattgtcctagatacattatataattcagttttcaaaataattctatatgttttattagctcttaacagtgaaactgaggttgaaaagattaaattatttgcccaatttcatgttttaaatccaaagttttatgaagtcagagcttccttcacaatgatacgattctctcaagacctgaaagttacctgatttttcctatttatatcatcctatctacttaagaagcattaaaatcttataaattcctgcaaaactatacttttgctattttctttttcagtttgataaattttgtctcaaaataaagaaaatggcatcatgatttgcttgtaaaacatcctttcaataaaatgtatcaagtgtctactatataactggagttatagaaataaaacacaagtctcatacattcgtagagataatattctagtggaaattgactataataataacattagataatgctttgtagaaaaataaactagaataaagggttaaaatttgaagctgggtatcatttcttacataatagacaacggaatcagagaaagcctgtctcaataggcttttattaaagcagctaaaagttaggcacaattctaattatttttaaagtataatcagctattattttgaaaaggctcagtgtatataaactacttctgcagaaataaacaagacactgtacaattgatattccatgcataaatgttgataaccatcaccctcataaaacaatttacatgacaccaaaaggttaaatttgtgaactatcctgaaataattgttatgaatcatatatgcttttcttatgggaaaatcacatatgctttaatccgtgcctactgtattttatttggcatataattactaaaagtttagttatctgactctttaaagcttcttctggcaagctgaagtgatgatattttgctaaagaggcaaattgacagtgacgataattgacctctgtcaaactgaaatcaacagaagacacagaagaacaacctaatgcaggcagagcttaaaacctagacaacgggttgataggtgcagcaaaccaccatggcacatgtatacctatgtaacaagcatgcatgttctgcacatgtatcccggaacttaaaagttaaaaaaaaaggtgatatgtatatatatatatatatgtatgtgtgtgtgtgtaatgaaatagtattcagccataaaaaggaacaaaataatggcatttgccattattggagaccattactctaagtgaagtaactcaggaatgaaaaaacaaacatcatatgttttcactcataagtggaaactaagctatgaggactcaaatgcataaagatgatacaatggagtttggggactcaggggaaagggtgggatggaggtgagggataaagactgtacgttgggtacagtgtacactgcttgtgtgcaccaaaatctcagaattcaccattaaagaattattcatgtaaccaaaaaaagaaaaaaaaatttaaaataatggcagctaaattagggtaattaagggtaaaatagtaaagatattttaaacatcttttacagtatcaaaatataagaactgcagtttaataaataatcacaactagattggagttaactataacatactcagccatggtgagtctacactgttaaggaggcagagggacatgccacatattttacaataatttaaaacatatatattgcttaatattagtcaacttggttttaaaagactaagctctaggcatttagacacattgctttgagaaatgacatatttcctggactggccagactgctttttgagtaaattggagccacaaaatcaaggtatatattcaatccatgaatgttatgatttctcatatgcagcattttgaggttctgatacatcaaagcattctgaataataaaatctcacatctaatttttatccttatttgaagacactctcaaaatcttcacatatttccaattagactttgagaaaacagtaagctaaattattattaaaacactcttaaactatatgtttaatctgaacattgtaatgattaaaatgacccactcagattaaaattgtggttgttcaaatactgcatgttattatttataaatgagagtcaacaatgggtacatgcagacataaagaaagaaaataatagacactgagggctccaaaaggagggaggatgggaggggcatgagggctgacaaattagctattggctacagtgctcactatttgggtggttggcacactcgaagcctaaacctcaccaatatgcaatatatccatgtaacacacctgcacatgtatcccctgaatctaaaataaaatttaaaaaatacagttaaaaatcatggtcatataaaaataaatatataaggagacaaaatcaattactctgtaagatcttctatctttttttccactagagtaggaggcacattggaaacaatgacttgcatatccagctgattgaccacggagacctgaaagaagaaaaaacagaattcatttaatttttactcactgaaatttccataatcagaaaacccccacattacctcttccctactatgcatagacacagtggtttctgattttcaaattcaggaacaaatatatatacatttttaattatatgatctacacaaggggttggagactaactggggcagactgagcatgagaaactatttgttgtttacctagaaattaagaatcctgagtgatttcaattgtttttggttatgtgtttgttttattggttatttactgagacatgaagggtggcatttttttttaatttgattgttaaggaacacccaagataatgaaaaatacgttttatattttacaagtcttgagaaatcatttattcattataactaagaatctgagatatgactggttagaataattcattctatgaggtcatcacatatagttttcttgtctatttaaccaactttaaatttgtgtaggtagaggtatatatttagaactttacatatgggttaaatgagctaatttaatggctgttgataactatgtatcattcatttaaaatctactgaatttcttctatgttcttatatttgaaaaatagaagaaaaataaaaatatttattctgtgcttacaacatggcatttcatcttttcctcaatattctacaggtttaactcattgaaatctatcaacagaatcaggttgttattaatatcatttcgattttaaaacaaaaaaaataaattgaggatatatttaataacttaatcctaattaaatgcagtctgccttacaccagagcttgtgctctttactattatccaatactgatataaaaattctaaaaagccatatattatcatgcacatacatttatacactattaaaatataaatgcatttgtaccagaatcataaattgaacactctgagttaggcatatttagcaccgtatctcaatacaatctacagtagggagtaatttcacattgccacacatgtttttataggctccagattctttacatatagagaccccattaggggtcacaaactcaaatgccttcaggaaccaggcaggtaacttaaatgagaaaagtagccaaaagtatgaaatgatagaaagaagtgtaagtaacaaatccaagagcacataactctgctgaagaggtcagctactactcacctctaaggaatattgcagtgtgggaaacaaaatccagatttcctagatatttcagtttttcaggaaaaaaagaaatccaaaatattttgtaaaatgtttgcaactagttagaaatctatcaaaccattgtgtgagcatgatcaatcatgtctgaagactgtattaagacaggagtaggtctgattattacttctgagcaagcagtttatgctggcagttctaaccttgtacccctaacccgtcataggtgtctgggaccaaatgactaaatttcccttcaacatgtaaatgagtcttgattatctttttacaaaacactagctacttcactagcgaactagcgaaagggatcattacagtttttgtatcactttgtcttttcttattggtcttgagttaaagaggatatagaagttgaatagaaatattttttgttttattgtttttgagtttttagcagtaaaattacatgataaaaatttctagaagtatgtatatgaaacttgcataactgttccctccctccctcccctccttccttccttctttcttccttccctctcctcctttttttctttcttttaacattgggccagaaacggttaaaaaaaagttttgataaaaatcaaaccacccggaacaagtagtaactatagggtgttatcccaacgagaagtataatcactaggcctcattctctgttccctgaagctcccatcatctcctctaactgctggactcagaagtactggagtcctggcctcaggacagaggagcttttgcagtgggactagtgctgaagcacttcctaattccaccatctgttgggagaaagctcctggaccatgatgtgggttatggatagggtgagtagtagggaacattagcaggatactggaaaagagaagaaaatgagtaggagaaataactctttattactggttctttcagtggagaattgttaggactgtctgccctgtcaaactgtcctcttctcacatgtctgtctcctggtctggtaagcatgtgcttcaacccaccttttctggctgacagactgttacagatccgtactattagtatcccttgaattttccactgtctcttatttccctacattcatcctgcccaggccttcaaaaatagacccttcattaaactgtcttcaaattatctgactcttgcagcggagacttaaaattaaaaaaaaaaatgtttcacatgtgcatgaattttctgccaggtccttactgatatagatccgaaaaaccatacaatcaggtgtcaggctgtatataccagaaatcggtcacactttacaaatatgatatatgatgtgaacaaaaacaaaagtgggaaaggaactaagtagtaactagtggaggatagattcagcagcctcagaggaagaccaaacataagccttcctatcttagggtagaaacaggatttaatcaaggaaatctcctgctcccgggatggggatctacattatatatacccaacaggatttcagaattggcctggacaattccatatgtctaccattactgtcctcttcaaataggaatttctagtggatattctgtatttttccatcatctatactgggtgaatgtgtttgctggatcactaaaacatcagaagttccctctagacctgataaaaagaacagcatgacatctgagatccaggtgttaactttgataagactttgttctatttgtgtggaaaataatgaaataaatatttggtaatcagaagtatagactggttagctgttcatccagctctttctgtcttcccactgggaacacacagtcgatttctcagccttctttgtagtttagtggagccatatgatggagttctgaccaacgtaaacttagtggaagggaaggaatgaatgttcttaaatttgaaggatagtcactgctttctcttcatcagaaagataggttacttattcaaaatactttaagccaggcgtagtgcctcacacctgtaatcacagcattttgggagactgaggcaggctgatcaattgaggccaagagtttgagagcagcctggccaacatggtgaaaccctgtctctactaaaaatacaaaaaatagccaggcatggtggtgcatgcctgtaattccagctactctggaggttgaggcacgagaattgcttgaacctgggaggcagaggttgcagagagtcaatatcacgccactgcactccagtctgggcgagagactctgtctcaaaaaaaaaaaaaaaaaaaaaagtgagattttgtgcaaaattctgactgaaatagtaggagctaacatttaaggtatctagaatatatccattttaaggttacattttattaacaagattttatgatgttaatacattttgaaaatatacttttatattttattttaaggatataaaaataaaaaacatttaattctgataaattaacagaagtcgcactaccgggagtagttgtcccacacttacctctaaatcattactttaaaatttttaaatctcctgaatgtgctaatgtctggtttatgtagaacacacacattttgactatgcaaatgaagaaataagatattacagtttacatttggtctttgacagaaattctacatcctaactctggtttgttttatcatctataacaaggatatttagctgtttaagattagtagattttatttatgctacttttccagtatagcttctgcaaatatgcaaatatttccagaaatttgcatgtcagtttattacaccaaatatttaataattctctgtgaaattatttaattctgtagcttaataactaatgaaagctttataaatatgtttccatcatcattgagattgatatttgtaatggattcaaattactaggtattgttaaaaagaagagaaataacatttgtgaagcacaaaattaaaaaagcaatggttggaaatttacatgttactatttctatgtcctttccatttattctcataagtttcttttctttcttcctctatactctcataaattttaaatagtgctgtccaatagaaatacaatgtgagccacgaatacaaatcacatatgtaattttaaattttctggcacccacattagaaagataaaaataataagattaattcaataacacatttaacccaatatgtttaatatatgtttagtaaaatatcattttaacatgtaaagaacattttacatatttttatcaaagtctttgaaatctggtgtgtattttatacttatagtacatctccgtgtgacctagccatgttgcaaatattcaatagctacatttggctgatagctagcatattggacaacccaactttagagatattcatcatctcctgcttgaactgtctttcctaactaactaactggtctctgctgcaaactcacattttattaaataaaagaggtgttttaatagtccatttagataattatgtattttcttttttaaatactataccaaaatttagtttccacatgaaatctgaaaccatgttcagttatactacaatctatttgtctgtcttgtactttttttttcttttttgcgatggagttttgctcttgttgcccaggctagaatgcaaatggcgtgatctcagctcacagaaacctctgcctcctgggttcaagcaattctcctgcctcattctcccgagtatctgggattacaggtgcccatcaccacacctggctaattttgaatttttaatagagacgaggtttcaccatgttggccaggctggtcttgaactggtgacttcaggtgatttgcctgcctgagcctcccaaagtgctgggattacaggctgagccaacacacccggccattgtactttgaattgattttttacacgtgcataattttttaacatcctgcattggccacttggaaaatacaagtttactgaacactgcagatattgtaaatatcaacacacttcattacacaatatcaataaataaatcacattatttaatacaaccactgactcatcaagaaagtctaaatattcggaagctagtcaagtttacagtgacaggtacatttttttaatattctaatttgtgcttcaaagcttcagtattatcattagttggttgttttcaatgaaatgacaggctcccttcatccattttgtgtaaatgcctaccaaatatttaagtttgaataaccatattttgtctctaagttgctctttcatataaaaatgttagtccataaaaaaagcagcttgttcagcttgcatagtgcttttccttgaggcaaccatcttccacatacagcagatgtactctatgcatacttctcatttcatcaacaaaataatgaaaaggtgtttaggacactttcgttgataggttagctagctgcctagatagatatacagtatttactaagggaatgaatgtgaggtttaggagagaaaggagtcaagaaattttttgcctaaggaactcaaagtgatttggtcatcaaataaaatgaggaagactacaggtggaagaaatgtgatgaagaagagaaatccattaggaaacactaaataaacaccttttaaaaatattcgggtggaattgctacatgtacagataaatatgcaaatctggtgttcaggaatgatctttagtgtaaagatgtaagtatgagcgcttttactatgtagatgatattttaaagttatgggactaagtgagcttaacaagtcagtgagtgcagatagaaaagagatttaatgtctgagccctgagaaacctcaatactacaaggtcaggagaagaaaatgaaccagtgaaggagactgagaaggagtaaacagtgagatagtaggacaagggagtatggtgggtggtctgaaagcatagtgagggtaatagtcaagcattgctgatggttcaagtaagataaggactggcatcatcagtacatttcctaacatggaagtcattggtagcatcgacaagaatagtttggaagagtgtttggagagaaaacactcttatgattagagggtttaagagagggtttaagagagggttcaatagtgagaaataagtcaaatctaacatagaattttgctaaaaagaagaatagaaaaatggatggcagctagaaggtgatatagatcaagggatgttttataatttttggaagatagaaaaaaagcattgttgtgagaataatctgatataaggaggaaatttatattaataatgtagaaaagaaatgggagagctgctgaggcaatctcctagagctggcgagtgggaattgaatctactgcataagtagaggtacaggctttagataaaaacagaattcatctaaaggagccagaaagaaggcaaagaatgttggtctagatcctggagggtaggtaaatttagtggcaggagtcatagaagtgtccttctaaatgctttagtattatttttctgtgaaatagcatgccagttaatcaggccatagtgagaatgaggacaaggtattggagattcaggagcagagaagattttctaggacatcgaggcaaaatagagtgattactgaccaaagcaaaagctcatttggagggtttgttttagtcattaatttaaattgatactgatgcaggagaacagggtctggaggcagggaacctaaggccaatttgtgctgacttcctaaagctaaatcaaagggaaaacaccaaggtctggggtcagggaatctaaggccaattcatgatagttttctaatggtggattaaacaggaaactcctgggtctgggggcagggaacataaaccaattaatgccaacttcctaaagctaaacaaacaaacaaacaaaaataccatctccccacaccccacctgagtaacaaaggatcaaaggctactctccctaaaaccttcccccttcccccatgtctcagatggaaagggaaagtgccttggagtggctgtgggccaagcaggggccatcctttcatttgcttagggcatcaatccactcaggccttgggtcaattcagctcagcctttagcctcaggccaaatccttcatccagataaggggtagcccacagggacctcaaaaggagtattaaaacccagaaaactttgtaaccaggcccttgagtcacttgcttgagtccactcccaacttgtggagagctttcttgctttaataaatccctgctttccgaggttgcagtgttgcagtgagccaggatcgcaccactgcactccagcctgggagtcagagggagagtccgtctcaaaaataataataataaaataataaataaataaataaataaatgcccactttccttgctttgttcctttgtttcgttcctgtgttaatttgtgtgttttgttcaattctttgttcaaaacaccaacgacatggacaattcacactcaaagccgtcatgtaacaatactatagctaggcatggtggtgagtgcttgcagtcctaggtgctagggtggctgaggtgggaggattgcttgagcccaggattttgaggttgcaataagctttgattacaccactgcactttgacctgggtgatagaaccagaccttgtttcttagcaacaacaacaacgatactaattatagaattttgtatgtttttgcagacataatcagcatggatataggtctggagaaaggagacagttggaattaaccaaagtggaggttttgctaagtgaatatgacatagagaaagaaagcaagaaagttaaattttatatgatgtactgcttattataattggtaatgcattataaatccagtaaacaagaaagagaacatgagaggttctcatgagagaacacaatggaagttaaaattattcggctaattggactggacatcctggtaggaacaaaagaatgatgggtttagctgcaatgttaattaaatgttatggacaaagagtgggaggtttgaaatggaggttataaaggtaatggcaaggtaagccaagaacagaaagttaaacaccacatgttcttattcatatgtggaatctaataaaaagtgtttaccgatcttaatttgatcaaaaatttatgtcaaacttaatatctcctatgtcaaaagcttcttggcttagagtggccttcatttactctattgcagctttactgttaaaaatgagaatgctcctggaggactgttttggccacaatcatggtgattgttcttcaccattatctaagaagaaaaataaagcattgatgtctgcatgtatatgaaggttacgcttgtccagggaactaaatgagaagaactgcgaaaaaatgaaaatttatgatgtaaagaacaaaagacaacttattcttgatctgtttttatgtgacaaatatttctaatgaatatactttgtattagattcatcagacaaaactccaaataacccatgctttcaagttggtaaagagtccacaggatatatgcactggtgttaaatattttcaatacaagctaatatcaaacttccctttcaaatgatctatcactaaacttctgcactgcctaagtgaaaattagaacagtgatattattgactatagccaaatataacttagtcaaggctaaacaatgtcatcattgggaattttgatagaacaaagaaataaatactattggaacaaaatttgtccccaaacattttctttgttttctcaattacaaaatgctgaaagtaatttaaacaaataatttcatagtttaatttctatagtataactctgtgaagcatttaaaatttttatgtagcactggacaccctatattaaacatgagctttgaagacaaaatagaaatccagtgcttatacctttgctgttacaatcatattttttcaaatattataatgtttttctcaaaggtcaagaaaaataaacaccttacggtgtttttgtaaatatatatatatatatatatatgaacaatatatttacatattcctaaactatagtgactaacaatctgagtgaaaataataattatgtttttgaaaacccgttttaaattaatcttagaagttctataaactgaaaacactgacctatggctagtatcgtagctacttccctttcctgaagttttatctacttacgagtacatcggctttgccgctcagtcccttcccatagtcgtcagttgcaataacttgaaacttgaagtaggatctcctcatattatggaagagcatagcagttttgataagccctgtatatgtttccactacaaatccttcttttccctctttaattggtggtattatgagtctgtaggccatgacactataattgccagtatctttatcagtagcctagacggaggggaaaaaaaaagagattataattaagcaggaaaagataacccttatgaaatggcttacttttgtttgtaagaatgaggtttcttatgtaataataacacaataaagccctcctaaatgtctgttttttctggatatagttatgtagattaatagactttgtgtccacagtttcgaatggttgctattagaatgataataactgctgaagtatgaataaaagggacataggtataattctgtaccctttaacaaatttctccctacccctcctttccttttacccttaccagcctccagtatcttgtattctacactttatttttatgagatcaccttttttttagattccacatatgaataagaacatgtatgtggcatttaactttctgttcctggcttatttcatgtaacataatgtcctagatagggagaatatgttctagtgctctataccactgtagaataactacagttaacaatagtatatagttccaaatagctagaagaaggatatcgaattttcccaacacaaagaagtgataactgtttgagatgacagatatgctaattaccctgatttgattgctatgcattatacatatagaaacatctatgtacccaataagtaagtactattattatttgtcaattttaaaaatagattttaaaaaataaacagacatagacactaacagagtcaatgaatcaagacttttggtttacaggtttgttgagttcaactgtgtgtgctgatccaaattggttgaaagatgggattggttgtttacctaatgtttgtcttgctgtaataggcatacagtgtgatggtatttttgatgtagtatatagcctaaggaggataaatataaaagaacgtagtaaaatatctcgaatgaaataaaataaagttgagttataacaaatttagagatgcataaaaatattctaattaattaatgccataacataattctctaattagagttagaatactatccgacttcctttttaatcatcctgtatcccgattaaacatatttgttcctggtgataggtacttatgatccacatattaaagtttcctaccatttagaattaaaaaggactaacacattgtttagatttttttcatttgtttttaaatacagctatgagaatcatatattgggctggctttatggtgtctaattaggggtaattttttagaatgtctatttcagaaccatttcatagtgaaatacttggaaaataaatggtagataggagagttttagaggcttgataaaagactatatataccttattcatgatactagatatgtaagttatacattttcatttgttataacaatgattattatttttattatccgattattcttatttttacctatgctattattattaagtatgagtatgcatttatgatctgccattactaagaattgctaagaatcatacaaaatacaaaatacaatcacacaaaataacatcatacaaaaatagtcttatctaataacaatataaaaaactgaggaatatattgttttacttatataaattagtgatattcaataaaattttctgaaatgatagaaatgttcttaaccagctctgtcttatgcagtaggtactagccaaatatgacaaatgaaaagtggttgatgtgacaaagaaactgaaatttcaattcaatctaattttaatttaagttacataatgaaagactacataataagtagtaaagttgagacacaaatgattaaaatagtaaatcatagcaaatgtgtattaaatacagcatcaacttgatttagcttcaaattctatatatattgtgaaccatttaaaacgtttccagataatcatatctacttgttagaaaaggtaatttaaactactcaacacagataatttcacttcaggatcagctgtttcatgaattttctagggagttaatattctcttttctttatttttttctctgtcacccaggctggagtgccatggcataaactcggctcactgaaccttagtctcccaggttcaagctagcctcacatgtcagcctctgagtagctgggactataggcactccactacgcctggctaattctttgtagacacagggtctcgctatgttgcctgggctggtctcgaactccttgactgaagcaatcctcccatcttggcctaccaaagtgctgggattacagacatgagccactgtgccaaacctaaaattatctttagaagaggacaagctcaaactaccggctaatcactttagatagtttatatggcttacagcatggcagagctcagttttggtattagagtaatagtaattagttatcaatgttaggtcacattctcacttaaaggaaaaagaaaatgaacaaagaaagaaaaacagtatcaaaattttttgtacttaaactttgaaccacaggtttataatcactcaacaaaggatagcataagatagaaaaaggcatattcccagctaaaataagtcaaagtctgagtcaaggtatccaagacatttcttccacatagaatgagcaaatttgggcctaatgtcagatcagtcagatttggttacatattattctctatcttcttattaacatggatatttctatgaaacaaactttttattattaatgtaaactttataaaggaataacaaacatgcaaaaagtgtacaaattataaatgtaaagctcattaaaattttgcaaaatacacacatctacatgaccagcatttacatcaagaaacaaaacaagccaggcatggtgactcatgcctgtaataccaacactttgggaggctaaggctggaggatcacctgagcccaggagcttgaaaccagcctgcacaatatagtgaaactcttatctcttgaaaaaaaaaaattacccatattccagaatgcacttcatgcacttggagtcacaatctgagaccttcttaaggaaaaccactttcctaatctaacattgttgattagttatgcctatttttaaaactttacattgactgaatcataaaatatgttctattttctgtctgacttctttcattcaattttgcactgtaagattctaagcccttatatttaaaataaatactgtataacaacactatcacatttggaaaagaaaaggtggttaccataaaatcaccacagtgattgcttggtatattaagctactttacacagttctgactgattaacttccaatttcagtaagcaggtaatttcactttgcaatattcctaatatattaaattatgataactacaaaatagtcatattccatcttaaaatattaaagtgttctgttaaatgtgcctttcctgaaacaaattatcacttaatgcaaaagtttgggtgtggaactagacaatttaactcagaaataactattttcttttatgatttttcatataaatgccttaatatttgcagaaaatagtcaagaatgagataaaagtttttttaaaaatcttgtctactggaattaaaaaaaataaaaccctattgtcatatgtatgttatacagtaaggactctaatttttatttctttgaatgaatatgatagtctttgggatcttagagatcttatttcaggagatattcatcaaagatgattgccaggatcattagcatatttttcaaatctcccctcttcctcaagtatgttcagttgaatactagtaatttaaacagtgactgatgaaaattccaatgggtgccatacttaagagcaattgcatggatttttaatttttagtctccccaatttataacaaatacatattttaaaatccgaaacctctcctctaagatgtgactctgattgatgtggagcatatgcaataccatcatacatagataacaaccaaatgttctttctataaaatcaataacaggatacgatatctttaaatacacactgagtcacaccagagataccaataataaaattcagagcgcagttttaaatctgggtcaatatgtgaaaaataagtgagagtttcagcacagagtatattgtctctatttgttgttaaataattttaaacttacttttttgcttgttttttgcattatgttttggagtgaggtggactccaatgtcaggtgtgactttgaaaaattaataactcaaggccgggcgcggtggctcacacctgtaatctcagcactttaggaggctgaggcgggcgggtcacaaggtcaggagatggagaccatcctggctaacgcagtgaaaccccgtctctactaaaaattaaaaaaaaaaaaaaattagctgggcgtcgtggcaggcacctgtagtcccagctactcgggaggctaaggcaggagaatggtatgaacccgggaggcggagcttgcagtgagccaagatcgcgccacagcactccagcctgggtgacagagcgagacgtcgtctcaaaaaaacaaaacaacaaaactaataactcaaaatttcagatttctttattcataagataaaaataaggatgcccaaaaatagtattttaaaattttatatatattcatacgtgtgtgtgtgtgtgtgtgtgtgtgtgtgtatatacacaaaaatataaatatgaccaagtccagtgtaactattatagttacctaagttgtcataatggtgattcaaaaggtttaacattttttcatattatgtttatccatgaatatgtaaatttatgcaatcaatttagacccttattacttcagacatattatcacacaattgtaactcccttataactctacttttcttaattttcttttccagctctcctttattgcttccagttcttgttttgttttgttttgttttgttttgttttgttttgttttgtttttgagatggagtttcactcttgttgcccaggctggagtgcaatggctcgatcttggctcaccgcaacctccacctccctggttcaagcaattctcctgccttagcctccccagcagctgggattacaggcactttgggaggctgaggcgggcggatcacctgaggtcacaagttcgagaccagcctgaccaatatggagaaaccccgtctctactaaaaatataaaattagccaggcatggcttccccctcatttttgaagcaattttgcaaaacctcttcctcagttgaaatccatgaacttttgtacagtacacactctacccctccttgttgccaaacataatgaggatgttggtatcttgctctcagtctaccccttctacttcaacttcctccctctttacaaatttcagtattcattgagatgacacatccagcaacttatttttaaagtattaggcatgaataacattcatcagtctttgaacgacctcactgcatcgatttaattctacagtcacactttagtcttttgccttagggagatattccgcttaaagaaacactccatatttaatttatatattaaactttcatgtctaaattctgaccacaactttaatcatcatacttagttaagacctcttctttgatatcagtgaattttcagttctgcaaactgccttttgctcccattacttcagggtttatgtccctttctgctttatcatagaagtcagagttgatcacattgttctcatttctctctccttccacaacacctggatctttctcctcttggaccaaactaaccatcagtttactcctggtgactgaagagggcgcagagaaattaaataatcagtcagactagtgttactgtaagtccatggtctctgagtttcactgtgcctttgtctatttaggaaatccttgctatatgtaataagttctctttctcactccagaagtttgcctttttctttagttcacagattctttcagtcttctccagagataaggaagctctaattcccataaaatttgaggatatcaaatgtgagatctctcagcttttcatcacataactaaaaaagtacctatatctgtacttactttgactactttcttcaaatctcagaggagcagctgacacgtatctctcactgaaggtacttatgccttaatctgaatcactcccatcccttctgcatttaatgcttcatcagctctattgatctctgtccttttcacctctcctctacagactataaaacacgttatgtctctctcattaaaatgaaatgaaacttttcttttactgagtccacactcgtgacactagcccccaaacttccatacctatttttcacagttaagttcctcagaaaatttttatagaatcaccatctgtaattccttactttacaatcatgccttaaccgcagccagatctctgcccctgccatgccatttaatttgctaacatcagtgactgaggctggactccatctcagatcaacaatcagtctggtgttctttaaattaccaagtccatttatgttgtttgtataatgctgttgctgcttccgctgtttgctaacatttattgaacacttacaatttgccagatgctatgtaaatacatatattattacattatctcatgacatcctttccattgagtagattccattattattttataggccaagaaatggaggcacagagagattagtaacttgttcataatcacacatatggttgttagcacagtgggataagtctcactttaaagccactacattccacatgtgagactaaataccagggataaaactgcagtttaaaaataaaacaacaaatgttcgataaaatattctaagaaatcttcctagatccatcaagaagatggaaagacaataaatatgccagtcaaaaacaaagtgctatggactgattatttctccccaaatttatatgttgaaacataatactcaatgtgatgtcatttgaaggatgggcctttgcaaagcagttaagttcatgatggcagagcccccatgaaacggattggttcctttttgaaaagaggccccagagacttcctttgttccgttttgccatgagaggacacactagaaacgcagccatccatgaaccaggacggcctcgctaggcacttaatctattagcaccttgatcttgggcttccctgcctccagaactatgaggaaaaataaatttgtcttgtatataagcttccaagtctatggtattctgctatagaagtctgaatgcaaaagtaaaggtaagaatataaaaaccatagtactgatgggagctttcatttagaatttttttgttttttttactgacctgggtaaaattaaaatttaacttgtctggttttcagtagctcagacaataggaggcaaggccccaagcctactcatgaaagtgagtctattaagatttccctccccagaaagttaaattctcaccgtaagagtaaaggagaaatttacttttccccctgctaccactgctactatcaccccaaactgcaacgaaaactgtaaacttaaactttgctattgaggggagtgaagagaaaacttctttgagaatctaggacgaaatacagcccctcattttagtttgcagccattatttgccggccaccagtttgcccaactcaaggagaaatcataatattccattggtaaagtctaataggcctgatctccacctgaatggacagaaaaaccacaacctgagaatttaagagaaatcatctatgactgaaaatggcctggtctcctgcctgacagaagcaggtgctttttcaaaaacccctcctgcaagccatgcctaaaataattctaacaaataaagttccaagaaagatgaaaagttataataattatcaaaacaaacaagaaacaatcataaaaaagtccgttgagataaaaaaatcaaattcataacaacatagactttaaatatttgaattagtagacactgaatataaagcaaatatggttaatacatttcaataataaagagctttaaaatgcggaataaaaaatgagactcgttgaaaagaaatgaaaaagtatcttttagaaataaaaaaaaattagaattaaataccccaagatgggattgttagcaggttaagcgcagctgaccagggaattagtaaatgaaatgatagggcaaaggaaatgacacagaatgtttcacagagctacgaagatgaacaacctcaaaaaaaaaaagtttgagatatggagtttagaatgaaaattttggcaaatatctaatcagagtttcagaaagagagaaagcgagaatagaacagaattttccagaactgataaaagattgttatccacagatattaagaagcccaataaactgcaaacaggataaataacaagtaactcacacctagaacccacatgtcatatagaaactacagaaccacgtactgtaaatataataagtattgttttcttaatattttgggaaaattcatagagatattttagtaatggcataaataattcataaatatattctataatttattaatagtaataaggagatgtctaacaagttgggttaaattaatgcataaaaattaaaactgactcactgtggaaacgctaaatgaatacaatttactaaagaattaatatgatattactttttccaccaatttctctataatcaaacatttatgctcagttcacaacaaagtcattaatatctgggagaggtgactctggaagatttgattcactgacttttatgagtttcccttagtgaacaaaataaaaaaaaaagttagtctagagttcttttaaaagaataaaagtcagaaatgaatattataattatacttgctataattatattttaagtgaaagcttagatacaggaaaccacttacccatttctaagacctcatctggaaattttaatggatacagatgtacaacattaaaagaaaatcaccaaataattgcctctatcatacaggggagtaggggagaccattaattttctaatagcctaaataactgttcccctctgttgcctaaatgaataccatggatgcagaaatattagtgaaataattagtgatgtcctaagaactttcaaacccattaaagttcagtaatgccaagtttaactttagcttctcaattagacccattttaacatttaacggtattgaaggctcacttaccctgaaatagagtgaaagtgttttagactgtctggataaaaatactcaaatctcacatttccacctaccaaggtcactatgtcaagtttgcaaaaagcaaaaataacagagctttggcaggttagaaccactttaacttgagtcttgtttttttttttgtttttttgttttttttttgacacagtcttgctctgtcaccaggatggagtgcagtggcatgatctcagctcactgcaacctccgcctcacgggttcaagcgattcccctgcctcagccacctgagtagctgggactacgggcacccaccaccagatccggctaattttttgtattttaggagagacgaagtttcgccatgttggccacgatggtcttgatctcctgacctcgtgatccacccggctcggcctcccaaagtgctgggattacaggcatgagccaccgcgcccggccaactcttgtatttttagaaaccagaaagaaatctttattttaaagtccttaaagacaatatacccagaacatgataaaatatgaataagaaaaatgtcaggtagattgatctacttttagggctattcaaaacttttgcaaaaaaaaaaaagaagaaacaaggagagaaagagaaaagaaacattttaaatatgcaagctcaagtgtttgattttgcataagaatgtcaaacagtgactacaatgcaatattaataatttctaagttcaacatacctatttactttttgtagagttaagtaaaagtctaatataattctgagagattctaaagagtaaaatacaactcattgtagaaacagcaatgtaataatggaaacacgccagtgcaacaataatagagacatgccatcatagtttgaattacaaagacctttacagggctgggtttcggttagaatttatcaaaatttactcttaatttaaatcatggtgcaaaaaattacaggataacatctatttagaaaattaaagaaagaaactaaagaaaagccaaatgttccttttattattttaaaaaattatatggtaaattctgaaccatagaaggcttgagagtacaaaacaagcaggacttgcatgtatgttataattgaagtttccttttttattttttcctttcttttaaaaatgttttgtaaaataaatattaccctataaatggttttgctttttccgtcattattgctaataataaaatgattatacctccctcagagatgctttaaaataaactctgagctaattgttctaacttttcaaccatgtgaaaaagaaaaaaattgtgctctattatatagacaagttaacaaaagaaaacacacatgtaatttatgctttttacttgagaggaaacactagtttaaatgttggtttggttttgaatcacaaaatgctattaatttttaccgaaaatatccactcttaaacagcttatcttttacaataattctgtagttatacatcctaaatccttcagcattcaaagcaaattaaataacatacttgttatttttgaacttcctgatttttccttagttacattaggttcaatcagtccaaaccaaattcagctgctgcttcttggctcccaccttgctgtccctcttctgactatcatatgtggttctccttctgttttttctttttgcataggaagggcaacaccatctatgaactgaactgttctaaaaaatttcagcatcctccccctcggtttaatctcacctcctggctcctccctacttccagtccatcagcaagcattctgatttctacctatacaatatttctcagttctgtataatactttaggccaagcttacactggccaatttcaggctctcatcagatctcacttttaactctagcgatagcttaaaaattactgatagctcccacttgccagagatgaatgttaaaacaagtcctttaaatattctcaatctgattaaagttcatgattccaactttttgctttacatttattctacttcccagaaccatattattttgtttttctgaagaatgtgttctttcaggtttctatttctttgtatacattgtttcttctaccttaaatgaaatgtcttttgtctgctaggccaaatgatgttcacttcttggctatactatggcacacacacacacacacacacacacacactttgaatatatatatatatatatatatatatattctacatatacatacagtaaactatggcatacacacacacactttgaatatatatatagactatatatattctatatatatagtctatatagtctatatataatagactatatatactcatataatatattctatatatagtctatatatatactatactatggcgtacacacacgttgaatatatatatatatctccatatatataaaatgtgtgtgtatgccatagtatagtatatatataaatatataatatattatatatatacgtgtgtgtgtgtatatatatatatataataaaacactgaataaagcaatcaaacctcagcttaaatgaccccttttctgaaggtgttcttatctctactagggagtgctgcttctacttacatattttcattgttatgttacataaatgtgtgtgtatatattagcatttattatgacacgttttaattttgtgtgtccattatacgtcaaatttgtttcagttcatatttttcactgtggtaccacgtgcagtcagtggtcaaataatatttggcttaaatgtctatagaagactatcatagtggttgagacatcaataattagaattgaaagatttgagtttagttctaccacttattagatacatgagcttgggcaagtgattctctaaggctttgctcctcatttgtaaaatgaggaaaataggacatgctgaataagttggctgtgaatattcactcgggtgtaaaatgcagtgcctggtacaaagtaaacctaaatcaaggttagctgttgttttactattgcatttactactgagatctttgaatactttgtagctatcttcctgatctcttctatttgttctttttttttttaaatcactttttgtacacttaaacgtacctttcactttctgcatcgtgtcactggctataaattctttggaagcaggaccattttctgaatcgtctttggatctcataagtctcatggccagtagaatgtaattagaaaatatttgctaaagaataaatctgccactgaggaaagtatagttattgatgtctctttactgaatgctatataatttattgatagcaaagcaaaagcacttaaatagaaaatatttataatgatacagatataataagatgcttataaggagggtgggagccaagaagcagtagctgaatttggtttggattaatgaagactaatgtaactaaggaataatatagaagtttggaagtttgaaataacaagcatgttatttaatttgatttgaatgctgaaggatttacgatgtatacctacagaattattgtaaaaggtataccattcataaataatttaagtataggcatttttggtaaaaattaatagcattttgtgattcaaaaccaacattcaaactaatttttttctctcaaatagaaagatcaaattatacatgtgttttcttttgttaatatgtctatgtgcctcagcctctcgagtaccagggactacaggcgcgcaccaccacgcctggctaatttttgtatttttagtagagacaaggttttgccatgttggccaggctggtctttaactcctggcctcatgtggttttgccatgttggccaggctggtctttaactcctggcctcatgtgttccgcctgccttggcctcccaaagtgctggtatcacaggcttgagccatcgcggctagccgtaactttatattctatacttaaaatttgcttcatgataagctgataaatcctgtttgtaatttctgcattttgtatttgtactttttcattcattttaaatcttcttcatgtaaaacaaatattttgtactccaatgcagtgttcaatattaacttgtaatttctgaaaattttactgagaaaccactggaatatttagaaattcaaataaaataggtgttatgcatattacatataatgaagacttcacagttcataataaacatctattttaaaattacatggccacagattcaacccatgggcccaaaatttgcaacagagcaggaagacttgtattttaatatgctaacagtacaagtcatttgacctagagataaaacaatttaatattttaagaacacagggttcacgaagcaaacttgaacttactgtaaaatgaacttactgtaacatgatttcaaatatgaatagtgtataagaagtctattcatcttttaatttctaaatttaatggaaagtcaaaggaaagtaatagcagggcaattgaaaattaaatctgaatgtcgaatcctctgtaaattctgacaattttactgcctacctaataaatttacaaacagaaacaaaaagctctattacaaaaatttttaaaaaaacctttcttattgctttcatagtaaaagagtatgtcgaggcaaatataattcaatttataaatgttttaccttggaaaataaatttataattttcaaaatagactggatatatagggctatgatgaaagtaattattaccaaacaaaatgcctttagtattgttataatgacactaattgtaaagaagactgtatttatggactagaatggtactatttgtacatgggacaataagatctgtctcctcgaatttatataattgtaacatgttaatataaacaaccctcaaaaaaacagtgtctgtcctcagtgtccttcatttaaattgatggtattttggagctctccctcgtgctctctctctctctgtatgtgtatgtgtgtgtgtttaaaaacacacatatgtatatatcacatatgtatacacatgcacacatatatagttatttttatattttataacatgatgtattttgtgtcatgagtaccaacttacaagtttgctaaaaagaaatggctccaacaccagtaaaatttcagtgaaatagtcttgctgcatgcagctatactacctaaaatttcaggatttgttagccagactcaaatactgcatgttcttacttatacgtgggagctaaataatgtgtacacctggacatagagagtggaataacagtcactggagactcagaaaggtgggagggtgggagagggtgaaggatgagaaattacctaatgggtacactattagggcgatggttacagtaaaattgggaatttaccactacacaatacatccatataacaaatccacttgtaacccctaaatgtataaaaataaaaaaagtaaaaataatcattgataaaattttcttagcttaggcagcagaaagtaattgagcatgaccaaaaacgtttatgccaatagagcaaagagaaaaactgagtacacataataaaatttatcttttgaagttcacacctggactaaattattagacatacataatttttaatcattgaaaaaaaccaagccaccatgtatttatattcttaagaataatatttctaaaatgtgtatgctagattacttttgtctacataaaattatacatatttttaacccttgcgatgttttgatgtgaattgtggttcacaaaatatactgggaactaagtaaaaaaattacaacaggtaaatgacacagatctgatcaggactgagatgaaatattgtggaagcatccatggtcagagattgcagtgatttttatctgaagagttggccccaaaacaatttactatacaggatgattaacattacaattccattttgagataatttggtaaaatgttaatattatgaattgcccacttgcttttttttttttttttttaacatggagtttgtttctgttgcccaggctagagtgcaatggcacaacctcagctcactgcaacctccgccttctgagttgaagcaattctcctctgttgggagaaaagctgagtgttgggagaaaagctgagtgttggcagagaagctgaggcagggcttgcatgtctgtgagacttgctggctccttgcttctagcactccccttatctcaagcagacatatgtttctcattcacttgatacactgtttcctttcaacccccacatccacatcaccttttttgtttgtttgggcaccaataaatagcatgggctcccagagctcggggcctttgcagcttccacactcgtgatggccccctagtcccactttctctctcaaatgtctttttctcattcctttgactctgctggacttcgtcgcccccactacctggtgttgggtctgatcaccccaacattcctgcctcagcctctcaaatagctaggattacaggcacgcgccaccacgcatggctaatttttgtatttttagtggagatgggggtttcatcatgttggccagtctggtctcgaactcctgacctcaagtgatctgcccacctcagcctcccaaagtgctgggattacaggtgtgagccaccgtgcctgaccccaactgctattttttaaaaatatggttatttttcatgaaccactgatggaattgtaatacacgcatatctctttgcaaagttattagaatgtatttgtttttccctctgtttttcttttaaaatattcccaaatcatttacatctaattattaatgttctgtattatgtgtaaagatgaaaaattgtaaaaatgtaaatggccaatagtcttttataatgtgtttaatatataaaatgctttgtgcttcttgctttttagaaaaataccattaaatgcaaatggaccaaggaatacaaaaactttataattttatccatttacaggcatcattaacacattggtgtttgttcctttatgtttttttgatgtacatatgtatatacatatatgtacatacacacatatacatataggatattatgatcctagtttactgaaagaatacacatatgtatacatataaaaatacataagaatacacacacatatatacacacatatgcatacacatacatatgtgtgtgtattctatgtattcatatatgtatatgtgtgtgtgtattcttccagcaaactaggatcatgccatcctatagctttgtaatccatttttttgtcattagccagccattaagaatttttttgttttaaccattttctattttaaacatcatacaacagaaagagtaggataaaaatatcataatgatcaggtaaaattatttaaagagatatatttttttctttgcatcatcatctcctttttctcttttcttattcgttaaatctttgtttttacaaatccctgtgctaagggctgatactcggtagactgcagggaggaaactgctctgccacttaaaaaacactgaccaagaagcaggtcatctacactagttcctcacaaatgtcctttgtatggcaggaaggaagatatgtatgtttttaagtgaatacatacacatctataaattgttgtaaaataacccccagagaacaccaacattaccaaagcttgaaagatagtttctaaataacattcacatttaaaaggcttttgttttgtttgagatggagtctcactctcttgcccaggctggagcgcaatggtgtgatcttggctcaccaccacctccgcctcccaggttcaagcgattctcctgcctcagcctcccgagtagctgggattacaggtgtgtgtcactgcacccggctaatttttgtatttttagtagagacgggctttcaccatgttggccaggctggtcttgaactcctgacctcaggtgatctgccctcctcggcatcccaaagttctgggattacaggcgtgagccactgtgcctggcctgtttttgtaaaaaaacaaaacaaaacaaaacaaaacaaactggtttgtttttatttgatttggccaaaaaatagcactgctcaatctgtctttaacttacttgcctttggccaacttgctctaaaccaaattgttcttcagccaaatctgcaggggctgacactgacaactactggggcgattaaatgcaggttgagttttgtactgaaaaggagtaagagacagaagactatatttgaggaagatctgggaaatgtaagaaatcatctgaaagttgactcagtgccctgctctgttttacaccctttaacaaagagggtatcataaaaatttcttaattctggtagttagaaagaataaaagtcattccgtgggtgccatttctaaaccatggaagattaaattaatgaccccaaatcacacagttggtgagcagaacatatagtctttaactccaagcccccatgcagagttcgccaaaaaactgactgtactgagaaaagtatgtggtgggctgaagattattatcaggttccttggttcagaaacagataatacctgtactgaacagatagctttcattaaaaattacaatctaatatttctcacatttttccctctgtgtagatactgttaagtccagtaggaattagattaagacaagcagctttatctctacacctctttttcaggacaaagcagaagacaaaactggcaggacacagagttgcttgtatccttattagtgatgctacttcattaaatttcatgttgaaagataattcaatgatttaattgcatttaatgctaatcagacccttataaatgtaggtgagatacacattctcattgtattatttttcatttctcattagttacccctaattttcatgatgattactaacataatataccattaatactctcaggaggtggcagaaaagattatgtgtcatgctgtgattcattaatgccagagaaagagctgcttcgtttttcaatattttataggtaattcattctttaataatgaaaaataaattttctgccattcagaactttctatcaatacatttactttgaaaaatggcaatgttgaccatacctatatacaatggggtacttatggtctctctataaacattcttaacttgctggcctttcccaggctgggcttattttttatatagattgtgccccctccttctaaagaaaacttatttaataaatttcactgccttttcccttttttcctactttaattaagagaacttcaagatttatttccacttagcagatgtacattaattagtataatataatttcactccattttatgatatactgtggtataaggaccaaaaaaccttcaatatgccttttaaaaaaaagaaatattattttaaaaactgttctctggataaatttatactgatactgcttgaagactgtttgaagtgtttccagctgtgctgttagggtttgtttctcaggacttcatgcctgtacatatagagataattatttattttttcttaagcttaccatactcccagaaagaaaaatatcaagctacagataaccattgacaacaagaaaattctatgcaaaaatactttataacatggtgctaagataatactactcatttaaaacatataaatatgcctcacacattttaatctggtcagtattcatataagagaaccaactatctcatttaacatatacaaggatttagaaaagttatattgagtattcctcagtggaataatattttcatgtaaataatacactaaggtgtatctcaaagagaactcatctggtgacttaatggaggaatctattatgttgtattcagcttcttataattattccttattctactattaagaagacaaattagcattctatactaatgctgaaggtgaattctggaaagagaggcccagtattcagttttaagggcaaagaaaaatggctgtgtgttcaataaaactgtgtttttaataacatgtatgcactgtgcatgctgtttgaaacattttgattttgagattactatcatcttacagggaaaaagaacaactcaggtaacaggtaacaatgactattgagagatctattgagagaatgtctatttagagaatgtctaagttcagagagaggaacgaaccgtgctcagtgctttatgtgcattttctcatttatattcagataaaattcattagctagtgttgtcatcactctgcagacctgttgcttacagaaattaagaaacctgtccactcctggttacacagcccactcatggttaaataaaacctcacatttgtccttattatgcttttggaaaacggttagacttaaatatatcaaaactttatttttataatgtcctttatatattatattcattaacctttctttcacagtcttccgatttagcatacccataacatttggttaaactttaatcaacattgacttaaataaaatgttcttgtagtaattcctatcatgacttcatgtttttggggcaggagctgctagtcgtttcctgcccacatgtatgcctcttttttttttttttttttttttttttggcacctttgggctcagccgcatcttacactcatatcttagctctgaaccagaatattgagcccaaaaagagcccattcctcaaaagaggttgtttcagtatcaactggtcttgttctattcaaatgttacttaatctcaaagtgaatatgttcagagctcactgccttctgggtctggaagccacactgtttactttttcctatgatgtttgttctctgctgagtgtcgaaatccctccaactgccttttctaagatgcaggctgttccctttcacttatttttattgcccattttgggctctttatcaacgccctatattataaaacatcagcaaggactgtgtctgtgcttacgtttttgaaggatttatgaatctgtttttgacatgttggcatgattatgcaattttttcaggtccaaatgatactatactagctcatgatcctggattctgaaaccaagaaccaaagtaaacacatatgctagttcatactgactttcattctccctaccaccctgtctttcagatccaacctaaggtatttgattactggcacctctcagctactaccacctgtaatatagtatttcgtcttcctaaaacatgcattcttgctataaatgacaagaacactatgtggcattgttttaccaagcattaaatatcgagaattccttaacattaagtaaagagaagactaatatttagatggaataaactatgctaaccaataagaaaaatactagcttatccccttttgtcagaattattttatcttccatgaagaataacttaaaattaacagaaagttgaataatctttttccttttccttttaatttcaagcttgttaaacatttttagaaatgtaatatacatttctaaaattgtgtctctacagcttcacgtttcttctttgtttctacagtactctcatgaaaattcaattctcttccctgtatttttaaaaactcattaaacaggtcgggcacggtggctcacgcctgtaatcccagcactttgggaggccgaggcgggcggatcacgaggtcaggagatccagaccatcctgactaacacgggtgaaaccccgtctctactaaaaatacgaaaaattagccgggcgtggtggcacatgcctgtagtcccagatactcgggaggccaaggcaggagaatggcgtgaacccgggaggcgtagcttgcagtgagccaagatcgcgccaccgcactccagcctgggcgacagagcaagactccatctccaaaaaataaaaataaaaaacaaaaaacaaaaaaacaaaaactaactcctaaaacataggtaataaaagaatacaggatcttcaaaaaaagaaaacagtcattaaaaactacagaaatactataataatttgacatctactccttaatttggcagtgccatacaccatgggttgtaagaaagaagagaatatatagtttaaaaaatgctattaatacttttctccagcccctaacccaacccactcatgcagtttttcttcatagaagaagagattttgctggtttgtttaaacacagaccaaaaatatgttcacctctgctcaatattgtatagctgacattctctttaaatatatctgtagaccaattggatacaaataaacattccaacactatatatacatatatatatatatatatgtatatatgtacgtatatatatgtacgtatatatatatacgtatatatacatatatatatatattccatatcagttgtttggggtttcttaatattacaaatttgtcttacaaattacataggagtagaaattctaggtaaggagatatgcataagttcagatgtaatagatagataatatcaaactttttccaaaatgtcttactaatttttatcccctcagcaatatctgagaacttcagtcgcttcacaatttgattttgtctgttttttttttttttttttttttagtcattgtgatgaacatgtgttggtttcttatggtttgttttcaattccctagcagttaagtttgatatatatatatatatatatatatatatatatatatatatctcctgtggaaattgataagctgattctaaaccttatttggtaatgagcacacagagagagccaagagaagccaacaaaccttgaagacaaaaaaataagcagaagacttacactatcagatattataaaactatagtaattcagatagcagaatgatgcaaagacaaacaggtcaatgaaatagaataaagtattcagaaataagcctttacatccatgaccatttgacttagaacagagagaacacgtcaagtagagtggagaaaaaaaatggtctctttagaaaatgatgctggtcaattaaatatccacatgggaaataaaaaaaaaaaaatcttgacctcctacatcactccaaacacacaaaaaaatcccatatggactgtaaatctaaacataaaatatgaaataaaatttttggaaataaacttaaaaaagtcatgtttttgtgttactcaaagagcttttaaacaagacaaaaagttgctcaacatgaaaaaataataaattgtattaaaagtttctgctcatgaaaaagcataaaaaatagggtgaaaatgcaagccataccttgggagacgatatatccaatacatatattgaataaagatatgcaatccagagtatataaagaattctaaagacttaatgagaaaacaaaacaaacaacagaatgtccagagaaaaatgttagaaagagaccaaaatagtcgccacataaagaggatacaaatactggcaaaaaatatataaagagacatttgactatcttaactactagggaatggtaaacgaagcacaagaaaccatcacatgttcatcacagtgactaaaaaaaaaaatcagacaaaatcaaattgtgaagcaactgaagttctcagatactgctgaggggatataaattagtaaaacatttttgaaaacagtttgatattatctatctattaagtctgaacttatgaatatccccttacctagaatttctactcctaagtatatttgtaatattaagaaaccccaaacaacttatatggacagtatataggatatattaactgtaatatatttgtacaatgaaattctctagagcaatgaaaatgaatcaattattactacatgcaataataacatagatgaatctcacaaatatagtgtgagaaaatgaatctaaacaaaaaatacaattttcctaagtctataaaaatatcgtaaacaagaaaaacaaatttatggttggaagtcatactagttattcttacggggatgtggagcaggaactggtaatgctctgtttcttgacctgggcactggttacactaccgtgttcactttgtaaatatttatctagctgcacacttagaatctgtgtgattttgcatatgcaggttgcattatgtatgcagcttgtaataaaaattatacatcaaaaatattcttttaggctgggcacagtggctcatgcctgtaatcccagcactttggaaggccgatgcaggcggatcacaaggtcaggagatcgagaccatcctggctaatacggtgaaacaccatctctactaaaaatacaaaaaattagctagacttggtggcacatgcctgtagtcccagctactcgggaggctgaggcaggagaatcgcttgaacctggaggcggaggttgcagtgagctgagatggtgccactgcatgtccagcctgggcgacagagtgagacactgtctcaaaaaaaagaacaaaaaaattcttttgatatcagcattcaacatatcttggggtctattggcttcaggtgttgatagtctttcaaattactatgagcctcactgacttttgtccttttctagattactgggtttctaagagaccataaatgtctagggggagaaatcctggaaatgagtaaaatgaaacattattaaagagagaattatctttataaaaactagtgtagctaccacataaagtttctggatcaacttgatggagatgcctagtttagatgttatttttgttcactagaatgcatttttgtgaatccaggcatttcattgcctgtttttgaaaaaaaaggaaaaataaaaaaattttaaagtctctgcaattctcagattttcagtgaattacaactaaccagtgcaaattgtattctctttatgcataaaatctctctccaggcctgcgggtttcccttaaggtaaattaattgaaactaataggaagaatcatttatttcttatggcttatttggaactaaactttcttcataacgcattttaaggaactcttgtactttaccgttcttattggaaatattgatagacaattcaaaattaagatacatttatagaagtatgaataaacaatttttaaaagctcattttcctcattttttccccttatattcgtgttatagatctcctgtgtcaggtcagtacagcacaaagttaatggaggttcaagacattacaggacatcttcagacaaaagtaatttttatttgcccaatttatcttctgaattgtgccttgcaatgcagccttcactttcagaaaaattctgagattttcaaagggagaaccaaatgtcagtattcttgctctacagatgatggaggatgtggcctttgaaacataatataggagagtacacacaatcatcactactctaaaacttataaaacctcctaaaagtaaatgcaagcttacctccaaaaatagtattccatacctataccttggattgttacacatttaatcatctgagagatacaaagacatttaataaatttctaatactgctagagtgcactcaaactttaaaatatatgagccaccagcaagtttaggaaaggcaaaattatttggccatttaccaaataaactactttattttcatgtatcatgtccaatggctcttcaaattcataaaaagtccttaaactctctactttaaaaataaagtatccaggctggtcgttgtggctcatgcctgtaatcccagcattttgggaggccaaggtaggcagactgcctgaggtcagggtttcgagaccagtctggccaacatggtgaaaccctgtctttactaaaaataaaaaaaaaaaaaaaatacaaaaaagttagctgggtgtggctttcacctgtaatcccagctacttgggatgctgaggcaggggaattgcttgaaccagggaggtgaaggttgcagtgagccgagatcatgccaatgcactccaccctgggtgacagagcaacactccatatcaaaacaaacaaacaaaaaagtttccagttatcagagcagctttacatctatgttttttttttttttttttttttttccaagacagagtctctgtcgcccaggccggagtgccgtggtggcatcttggctcactgcaacctcagacgcctggattcaagcaattctcctgcctcagcctcttgagtagctgggattacaggcgcctgccactgcacccggctaattttttgtagtttttagtagagactgggtttcaccatcttggccaggctggtcttgaactcctgacctcgtgatccacccgccccggcctcccaaagttctgggattacaggcgtgagccactgggaccggcctcatcgattttgaaacatccaagcttccctcattcttcagataattatagtctgggaaaagtagtccgatttctattataagtaatacgaattaaagcaatttttaattaaattacattcaaattaataggcataaattgtttgctaggagaatgatattttttggtgtcccttctacaataacaaacaaactgatttgtgtggagagggggaagaagagtaaaacatatgcagaattatttcattgtatactcaactgacatctaaaatagacttcatcttgtccacttatattaaaagaacataacaagaatgttttacttgttcagactaataaggagaaatgctatgtatcagcaactggtaatgttttttatggttctcaactagtacaggagaaaatgcaggattagactatttgaaacggaatatcaagtttcagttatataggaggaataaggtaaagggatatattgtacaacatggtgactatagtaacagcgatatattctttaaaaataaaatacagaatacagtgtagaaacagaatagatttttttgtaatcatctgtctgcatttgtgccacagaatttcaaaatgaatgtgaagtattttctaaaaatatatgatataatctaaaaataattgaaagaaaagatgatagagagtaaacgtaaaatatataaaggaaatcagagaaagtcagtataccacaatttgtattgcattcatcttctaaaattgccaaagatggatcaaatatttgactttgagtgtcggtggaaaaaaacaaaaggaaaatattaagtacagtatagcctgtgatcatataacaaaaatagcccagttgttcaggaaaaaaaaaatcttcacatttgatgtcaccagtgaggctaaataaatgtaaaactatgatacatggataacattcataaagctgtcatcaagtctgagtttctaatttggcaagaagtgaaacccacagggaagtccagggtgatgttattctgtgttgtaatcagcccaaaagagtttaatgtaaaatgtattttactaatttgaaatgatcattcatgcaacatatgttaaacaggttaaaagacatgagtatatgtaaaaataaataaataaaattttaagaagtcattatatgaaaaaggtacttgcacacacgtttatagcagcacaatttgcaattgcaaaaaatctggaactagcctaaatgcccatcaaccaatgagtggataaagaaaatgtggtatatatacaccattgaatactagtcagccataaaaaggattgaaataatggcatttacagcaacctggatggagttggaggccattattctaagtgaagtaactcaggaatggaaaaccaaatactgtatgttctcatctgcaagtgggagctaagctatgaggacgcaaaggcataagaataatacaatgaattttggggactcgggggacagagtgggaggaaggtgaggggtaaaagactacacaatgggtacagtgtatgctgcttagatgacaggtgcaccaaaatctcagaaatcatcactaaagaacttatccatgtagccaaaaaccacttgttctccccaaaatacttttttgctaaactttttttaaaacccaggggtacaagtgcaggtttgctatatgggtaaacttgtgtcaggggggtttgttgtacccaaaaattattgaaataaaataaactaaattaaaatcaataaataaaattttaaacaaacaccaatttgaaatgttaagcccaatatataatgtctttaagttgatgggaaaacataatgtctgcttagatgaaatttaaattctagtaggaaaatcatgcacacagataaacgataacagtataattggtttaagtgctaaactagacatatagtgattcagttacagggtcatagtcaagaaggcaatgcaccctcagacacctacatatgtttgctttgttcaaagtacaaaccacacaaggtcaaacaccgtgccaaaacatgaaggaaaccagacgagatcgggcgcattcagggtggtatggccatagatggaaggaaaccagtgattagtaagaccttgtgaaaacacctctcccttgaaaccatgagagagtttcctcatacttggcaatggggaaccaaaattagtgttttattggacctttacttcaggctggttcttgtttgcatctgttctatatgtaactaggaagaaaattgtcacaaaataactcactagctttcaagtaacataaaccacaaatactgtaaaacataaatggtgattttgatttcagaactaagtaatctacgctatttgacctctaaaatgtggttctcaagtataacagttgtcacaggacacttgacattgtaacagtaaataacacataaataagcaaaccatcagcttaaagattttaaagggcacctgcttctacagcaatatttatgtgagaagatatctgtggcacagagtgatggagcataaagtctcacagagagataagagcatgcccagaactaaatccaggtgattagaatgtcagtccagtgctcttccactggaaacgtggttgagcttggtctcggaagcagaatgccaggctgtaaattgtagcctcactcccaattagctgcacatgttgggaaggttacttattgctcctgtgatgcactgttctctgtaaattaaagagatgctacttggggaaaatacattaaaaattcagaaatgtgctggagatgttttacctaagacccaggtgagcaggtatagggctagagaccaggagcccccaggagcccccaggagccctaacctctgtctagaaacattatgtattaccctacattgttaaccttgtacatttctataccttttgctactaaggaaatttgcatcctctgaccatgactgtggcttttttctatctacggcatcactctgctgaaacctctcatcaccagtttgtgcttttgaaaatgtaataaacaatcagccattaagtgttaagtcttttttcttgctgctttttcacaatattattttcttttagtccataaatttcttaaatttggcatctttaataattcaaaaatagaatattcaaaatctttttaactttcagtagagatcaaatcaacattataactcaattcttctgacactgtttttccatatgtgcaacttgtaaagaatgagattaatcctcactgcattaacttctggaaaatatcttcataattcagagttttttaaaattaatcttgatcacatttaacatctccctgtatttgcaataaatgctatttttgcagttaagacaacatgcaataaactggaaaaattagttaacaatttgaaaagtgtttttaaaatcaaatcttacttgttaccttaacagggggtgtcacaatttacacagttcatctcaagttgaaaagaaatcggttgcctttttacttgtctcctaatttttcacagaaagttagtatgttctcttattttctagcaggattctacgcctcatttctcctgggaagcaatgtaagaggttacaagaaaagttcttgaactgaggtagacctaactttaaattccaacttcactgggtatttggctgagtaatactaggaaagttatccagacttactgagcttcaattttcccaaaagtgcaataagaaataattgcatctactgcataaatcaatgtttaaatttacttgttttattttaattgatattattttatttattcattttatttatttatttaaagagtgtaggctaaaataagtaaatgacatttcacagttctcagaaaaataataatgacaaataaaccacagttattattatgaattagggaatatttatccattaacatttcttcaaagcccagcagaaacaaaaagttaatgttcaaaggcctagcttcaactttccttcttcacacaaaaaattacaaatattacaagtattcatcactttttctatttcttttttgttgactacatagttgcttttttacagttctttctatattctggatactgctcctttgagatatatattttttaatagatgtcgtgagtatttgcttttaacatattgcttcactcagtcatttatagcacccttgttgcaggagtctgctattctgatgtaaccatattcatcagtcatttttcattagtgtaggacaggggtccccaaccctcaggccatggacaactaccagtcggtgacctgttaagaactgggccacacagcaggaagtgagtggtgggtgactgagtgaagcttcatttgtattaatagctactcttcatggctcacataacctcctgagctctgcctcctgtaagatcagtggcagcatcaggttcttataggaacataaaccctatcgtgacctgcgcatgaaagggttccaggttgcacaaaccttatgagaacctaatgcctgatgatctgtcactgtctctcatcacacccagatgggaccatctagtttcagaaaaacaagatcagggcttccactgattctacattatggcgagttttatcattatttcattatatattacgatgtaataataatagaaataaagtgcataataaatgtgatgcacttcagtcatccccaaaccatccccctctgcactcctgtctgtgaaaaaattgttttccacaaaaccaggccctggtgccaaaaaggttggggaccgctggtgtaggacatttcagttaatgatgttcaactaatggcctgccctagagaaggaggactcagaattgtggggaggctttttcaacatacaaggtaatgcagattctatatggcctcctgacaggctgagaggattagcatgttcccacaatgcacatcactcccatattgttgcaactggtgttttatgaaataaaatgtttaaaaacgcagtacatagtcaagaaaaataaattgactaatataaatctttacttctgaatttgaacataagcttcacattcataagagcttcaaaggaatgaattaaattaaatatagtttaaaaaattttaaagtttaaaacattttataaattaaaaatagtttaaaaaaggtgttcacattctttcaataaaagtgatgccctctctcctctttttctttactgtggtaaaatgtacgtaacacaaaagttagcatttcaaccacttttcagtgtacagttcattgacattaagtgtattcacattgttctgcaaataccactgccattcatgctcaaaacgtcttcttcttcccaaacggtaacagagtagccattaaacaacagcttcccatttacctcctcccacttcacccctaaaccctggcagccaatattctgctttctgtctttatgaatttgcctactctaggtaagtagagtcatacaatatttgcccatgtctaggttatttcacagagcatgatgtcctcattaatccatgatgtaacatgtattagaatttatttccctttaggactaaataatattccattgtatgtgtatatcacattttgtttattcattcatctatagatgaacatatgtgttgtttcttttccctttttttttttttttttttttttttgagacagagtctcgctctgtcgcccaggctggagtgcagtggcgtgatttcggctcactgcaagctccgcctcctgggttcatgccaatctcctgcctcagcctcccgagtagctgggactacaggtgcccaccaccacgcctggctaattttttgtatttttagtagagacgggggtttcaccgtgttagccaggatggtctggatctcctgacctcgtgatccgcccgcctcggcctcccaaagtgctgggattacaggcatgagccaccgcacccggccccatatgggttgtttctaatttttagttgttgtaaatagcacttctatgaacatgggtgtacaaatacatgatcaagtctttggtttcaattattttaagtatatagtaagagttatattttaactgatattaactaattgttttaaagactaaagaaaaacgaattaccattggattttcttttcgcactcctcataattaaaatgactgattacttgtcactaacggaaatcaacttcgtagaaccagttgtgacacagatacccagcatgaaaccatagtaaatatagatcttctcagataactttttgttctgtgcacttttgatacaattcatgtacttaaatgtgacatgagccttcaaattattgagccagaaatcaagtatctacatgtctgtatatatctttgtcctagaaaatcctcaggagacctcccttaacaatcactgctcaaaaatgactcacatatccacgtgcaaaccaatcatttgcaaaggtaacaggacaggcatgattggctctgaccagccatttttcaccactttggaataggcttcacttcccctgaagcacatgatccccaaaaataatacctaaataaaactgaaattctgttaaagtgtgaggtaggagaaatagccaactaatggtgtctactatactcagacaatgtgagtatattaaaaccagagacttcacctaaattaactcagtggtacaaacagaataatttaaaactcaccttcacctaaatttcagataattatattattttccactcactatagtataaacatgaactgaaactaaattaggtattttgtccatctagatttaattataacatatgtttttatttatttactttttttcgggggggggtggtctagtttactagaatgtggcttctgtaagggtagagagagcctatttttgttgcttccatattttcagtacagagtaagaacacagtatatattttctttaaaaaaatgaacttagaacctaagtttttaagtatattaggtataccacttcagagcagatatacaattgtctttattatgttattacttatattggataattcacttcaacaatgtttttattgtgtcactttacctgtagcatattttaaaaataatgccccaaattcactactcatcttttaagctaatatagccttattcactgctatttcaaagtcttatcttactttgtcaatcttattctatgtcacatttcttctttcccttcttacacaaagcacatatttacatttaacttttatcattctgcgttatatcatggaccaaaaaaaattaacttgtatgcatggtagatgatctaccattacctaatattgtatagcaattggtagaaacacctctttcacaatcatgggctacttcccatttttaaaatcatctttccttccttcaaacaccacagctgaactggtcctgattcagtgctgtttgcattaatatttttgttgctctaagtataaaatgagaagaactgcttaactcatgctctgattaaattctggaaaggagatttcaggcttcaaggctaaaggcagcaactggaattgttaaacattaagtatttattactcccttccgctcgtaaatcccttgcctcctatcactcagatacgctctgcactttgtttcttctgagttttggcttacttagtttgtttcctctacttagactgtgtcttcctcacatatgtttcactttggaaaaaaaaatctaaccacccttcagtgctagtcttaaattcttcatcctccaggaaacctttatgttcattcaccaactgaaatgttttcttcctttgaatccacaagacaatttgcgctctgctacttgactttattattatagcatacacttgcataaacacattctttctctctctctctaaactttctctctctctctctctctctctccccccctctctctgtctgtctctctctcccctctttctctcactattgtataaagtacctagtatattatattgcatgaagttggtttcctagaaaggacccctttccctagtctgaattacccactgatagtttgaagggggagggttccttagagttctcagtagtctggagacacaatcaatcccaacactgtatacttcatctgaagaagtccatgcattctgtccagggcatatgtcctcaccctgatgcttctttcaatgcaatgtctttacacaccttattaagactcagtttctcacctgacttttacactactaccaaactttcgccagaatcccttggaaatcacagaccatcatcaacaaaatcccctaaatgttcaactttccctctgagtattacctatactttttgattccttctttctccctctaaccatcctcgacaaaagatgctgctttctgtagatctcccagtagtggctaccataatttacatagcacagagcccaggagtacagggcaagcatccttctgtctcctttgacactctgtcccaattcctctgaagtaaatcccatcagataatgccacccactaaatttccttgttatagtcatcacatgccttttgagtaatctcctttattaatggactagtttaacatttggcttatctttttttcctacatcacactataggattagtaacataagtggtgatgtaaaaatccacaagggcattctaatcacagtagcatctgacagtcaacgatcctcttttatcaatcttgttctttccatggttcagggaccttgcattttccctgtattcctgtcacctcatggcagcaacatctcagtatccccaaacccttcttctcctgatctctaagtgctgaaattcccaaagcttagtcttcgtattttttttgtcaaacccattttcagggtgatttcatcttggccccttatttctctctcaagtctagatcagcatttgcaaatgccttgccaagaattaggtttctgtattgaaaaagcctcccaaaccttgattactgccatcacaataggcagtggaggaggtatggggatctgttcaggacaaaaaccaccaagtcattcttgatttttcctaatgtcccatgtatgattcatcggcaaatcctatatgttctatcctttaacccccttctcaaggtctccatagcctatcaacgtcgttcaagctaccgtcaaatttttcctggactcgtcatgcattaaactctacttgtccaaaacactgtgttacccattcccaacatcccccatgcagcatctacaataatctttttatattggatgatgtcataactgtttaaatcattcaaaggctttctttccaacacacctagaacgaatcccatattctagccccaggtacatttctgatctcatttcctaccagactttttcattcacactagcctccagctccctgtctacctttagggctttacagagaaatcccagaatgctgctcacttaagaatccatgtcttgatcttttcctttattcaggtcactgtttcagttttatccaaaaagaactatcttaactttcttatctaaaattgcaccactctcattcttcccttatcaaacttttttgtttccttagaatttatcactacataacttactcatctattcatttcttcaactagtttgtctgcattactcgggtggaaactttgtttgtttgtttgctttgtcaattgctctatatcaaacttctagaacagtgtttagcacattataggtactcaaacatatttgactaaatgatagaactaaatcaattaagagttaatgagactaaaatataaaataagataaaaatcagctacaaaggattcctacttgtggataacaacataaattaaatgtaatgaatgacagatttgtggactacttttagttaaactggtgattcaggtcaggggtctgtacttagcatagtggaagagctattttgcaagcccaacccaattaggttgaattttttttcttactgagagtgtttgataggtgataaaactacacgtaagaagagctctaatcatggtgctcctggtaataggaaaagaaaggcaattactcatgtgcaaaactagaagcaatcaaaagctagatttgccagagatgtttaggttttatgtgcaatttacagctatttacaagttaaccattgaaatgctgtccaaaattaactccgcaattgagaatccaaaatgtttagcatctaaactttttcctcagtaaaattcaatctttaaaattttttcttagtaataaaacattagtaatacacagttgattagaaatagtcataaacatttgattataaactattataagagtaattagtaataaacatttgatgataaataaagaaaaaaattgaaaacttacaactttggtcttagatactgcatttttgaaattccaagtaagccaacattctctgagacatcaaggtttttgtaacttttagtaaagtactaaaactggtagtgttatttttttactttcattcaatcagcatttaaaattcacaatttcagaaaaaaatggttaatttattccactatttcttctattagaagtggtaattttatatttgtcattagagatttcattttgagaatcttttgagttatcctactggaggaatacaaaccattaagaaaagatatacatttcaacatcttattcaatgtaaaacatcgtaagtattttgttaccattttcatagtaaaatgaaactcaagaagttgcttagtgtttacctgatataatctgtattgagtttagataactaaactaatatagctccaagtttcaggcttttgtttatacagcataagtatgcagttaatgcaaactacaggcttacagcttatctgcaaaacctgagcttttactttagttctgtatattaacataattccgcataccttcactctgagtacagaagtaaacattcttgcatcttcagatacacctccgatgtagaattttttctgaaacactgggggatgattattttcatcctgaatctcaatgtatactttagctgtattgcctggaggacaagaaacgatgcattttttattggtggttattcatgggggaaaaaatgcactgaagtaaatatttgctgcacttttttttggaaacattgaaaataaatcaaaagccatttctagatgccatgcctagcacccccaaattcaggggacactgataatgatgcttctggtataaaaatgttaagttgctgttatttcttttaattacaatgtcctggtagttcactttacttgatttaatttggcactaaaatactgcaccctgttaattttaatgaaacaactctactgttcacgttcacaaacacttcacacacaataccagttataccaaagggacacaaatatataaaccccttatgaaatagtagaaactgccataaactattatatgaatatatatttattcttaagtataaaatcagcaatggcatttctttagcttaaaattgtacaataacttttatgttttaagactaaaagtaacagtgttcgggtgaggtgtttatttccacaaatggaaaacaagttttatcatgccttggaaactgtcaatgttagaggctaacattcattgaaaacaatggagctgaagatatgattatgactcataaatgctgcattttaccatttaaataacagtaaatgtaccataaatgatatgtcatcatcaaatgttagaacctccctcaaatcatcacacctttaatgagaaatgtggtacttgtcactagtccaataatgaccttttaaaaaacaatttaatatgtataaaaataacttataaaccaaataaaatgggaaataagtggctattcattttgtaaaaaaatagtcaaataagtattgctaatgtattacataagtcgacttttctgattcatttcagttatgaacaaacggcaattaacgtacatactatttatcaaggatgcccttattttggtgttttacctgtgtttaatgcctcctgtacaattttaagtaattaacaccagcctacttgcaggatacatcatgggtatacatttgtatttgttgaataaattaatgaatgaatagcttgtattagtaagaacttagaaatagtcttttttttttttttgcttgcccttggaaaggtcagacagaacagtgagttaacctcaagattttgctcctatcctgctgctactcattcagcttttctctgtttgtcatctgtgacctggaagaggtagaatcaagaggaaaatcatgctagcgcaacagattagagaaccaacagcgaaatagggctaatagcagattatgcttctctatcctgcagtgccagggctctgacttgtaccttagtcagccaccacaaatcagaattcacccaaaatgaaatcatttttagttcagtagcagaccacttttatctctagaataaaaaatgcgaacagctctaaatttaaaaataaaaaggaattttagaatatgtcacctttccaataacttctttgcactttcattcagaaacatatacaattcaaatgtgctatttcttttcagaactcttagagtgacagaggtctcggaaaaatactgatgacgtatattttcttctttaaatgggatgagtcatttaaaatgttatacaatttgcaaagaacaagaactttgtcatgacctgttcccttacctcccaaccctaacttcatatctggatggtaaccaaatcctacatgtcagcctcataagcaggtaaatcatcacctaataaatatatcttgtgtcatttttctctcaactccacagctgcccatatacttaagtctgttgttgtctcacctgagtgactaaacgtcatctgctcccctgtcgtgtctttctaatgtgtcctgcattctgatataacaaagacatcacaaaatacaaataggatacattaaatcaaatgttaaaccaaccaccattcatatgtacatttttttctttttcttgttttttgagatggagtctccctctgtcgcccaggctggagtgcagtggcacgatctcggctcactgtaagctccacctcccgagttcatgccattctcctgcctcagcgtccctaatggctgtgactacaggcatgcgccaccatggctggctaattttttgtgtttttttagtagagacgggatttctccatattggtgaggcttgtctcgaactcctgacctcaggtgattcacccacctcggcctcccaaagttctgggattacaggcatgagccaccatgcctggccgacaattcttaaaaataccatgtgtatattcatatccatacttatatgtatactttgtgcatataagtttaagattcaaataccaaattgttcctatgaaagctcctttgattcagtggcctgtatcagatattaagtggtttgtgggaaaaggcctatggataacccaaaatatgattatataacctgaacataatggggagagatgattatacttaattataatattttaattaaatgatatttatttatatgaaaactaatgactatacaatacaaaattccagaatacttcacaaccagcacacaaacaaaatctcaagaacattgtttagacttaaaagaacttatacatttatttattttaaaaagccacgatcatttagttcttttcacaaaagagaaacagttataatgcgatttataacaatactgtatcatgaattttgaaatttatgatgttagctatatagctaattatgtaggatagtttgtaatagtcaactaaaaataaatataaagttgtgaaaaaggtgttttcattaagtttgtgacttagatgttagaataaaaaaaattgttaacttttattttccataatgtaaaatagactagtcttcctttttttttgcttctccctgataactttaggcagttgttatgtatccctcctttgaaatgctatagtgcactaaaaatgtttctttctataaataacctttccagagcttggtttacattgcatttagttataagcatgattttattcttattagatttcaatattcttaaagatggaaattgtatctcctacatctatcagtactataatgcctcagtttgtaggtaatttttccgctcagatattattgtaacaaaatttcttaatttttgttgaacaaaaaagttgatattcaattaatttgttagctttctttgattataatcatgagattatgattaactgaaacaaaaagttaactcttagaaggatatgagggagctcactaaatcaaagtgaagtaagtccaaagaaggcttttggtaccacaaaataatcaggaagttgtagagcctttaaagcagcagatgtttgattttcttgcagatgaaataacagcaaactctcttcttttatgttattttaccccaccccttattcctctttttttttttttaaagaaacaaaccaaaaaacaacccactaggcttaagaatcataccctggggacacattacctgactgtcctagtttgggtcatgtgcttgctccttgtctcgggaaggagaagtcaccagattatccacttgagaagtcactgggacaattataagaaattgtagtgtgtctacttaaagaatgtaaaataaatgttggccagtaagaaaaggaaaagcaaataagtatacacctatagttaaatcactagaacagcgttctttttgacttttttattcatgtgtatacaatgtacatgacatcatcaatttccttggctcacgtgcttccccactaaggattgtaccatgttcttccaccaaatttggatattgattatttcaaggcagaagcttggaagcaactctgatttaaattcttttaagatagcctgctttttatctccttgagtacttacaaaaactttttttccatgttgtatcctttatttaatgtagacatcaaacacataacaaaagaaagatactagaaagagaaaggaaagcacagatagaaaaataatgttaagggaacaacgtgcgtgcctaatatcctagtattcccctccagtctcccttctggctcatctaaacaatgcaagtattggaaagagaaccacaaacagtgaaagaaattacaaagtaggcaaaaaagttatttggaaagtgttttggttaagagacattataatttttctgtgtgctttggggcaccctgccttatttttcttccattattaacttttttctccaattttctatgggacaatcttttctttggctagaacttttggctttagtaagccagaagttttaaaaatgactcctgaggtaagaaaatgtgagataccttcttgcaatgttttaaagaaagagaaaataatacttttatgtagtcaagctcaggggaaaatgtaagtcttagtatagttacctccttgaatagcacttctgttctattttagacatttaaacatggtagaaggagttcagaagagtgattttaaatacccattaacctcaacttgactctatgatttttaagaccaaatttagtttgatttttcccttcccttacttttaataatcaagactgtgatgctagttttttctttttaggaaggccctattatcctcaagatgaatccatttcatttatccacatgactaatctagtgcctacactgcactggattttcaaagaaagccttactgaataagaagccaatgagttaaaagtgttctcaactgggatcaatttggctgctctagagccatttttggtagtcacaacagtgtggataggggaacgtagtgctactggaattaaatgagtagaggtcaggaatgctgagaaatattctgtgatgaacagaacaggctcttaccccaaacgaacaaacaaacaaacaaaatatttgggccaaaatgccattagtgatgaggctgagaaaccccaagttaaataacaagagaaagaggaattagatgagttaagataaaatggaaagtttccaaatgctatagtaataccctctcctcaatccatctgcatgcacatgcctttaatgtggaacttatcaaaatatgctgtaattatttgatcacacattggttatactcttttttgactgtgtcctataaagtcaagggctcaagcctgtttacctccactcttgtcactgccttctggcctctgttcctgacattctctccatctaaaatattcttaattccaagccatttctctagtcattgccagtaaatatacatcacagaaatatttattcctgtacttgggaatgtagaagtttagtctgattaaaaaacatacactagactatattttcctcaaaccttaaaggaaaggactgtgcttttcttattgttacgtatcgttgcctaacacattaaatgatttttaaaattgttatcatgataaatgatttatagattcttcaaacagtcctattgcagagaattttttaaatgcttggaataccagatttatatttgttaatttgttggtatcaggagattgaagtcagttcctcactttaaaaacacacaaacaattttttatgctgtttttcttttaagacaatttttgtttaagctttacgggtatattaattatggaagcattgtgacttccacatagtaggtgatatggtttggctctgtgtccccacccaaatctcatcttgaactataatcctcacgtatcgacggaagaacctggtgggaggtgatcagatcatgggggcagttttccccaatgtgttctcatgtagtgagtttgcacgaaatccaatggttttataaggggtgcttccccctacactccctctttcctgctgccttgtgaagaaggtacttgcttctctttccccttccaccatgattacaagtttcctgaggcctccccagccatgtggaactgtgagtcaattaaatctcttctctttataaattacccagtctcggttatttctttataccagtgtgaaaacagactaatactgtaggtgttcaataaatgttaaattaaattgtaattgctaccacttcactactcccaagggtcctcttaaataaaataaattactctattttattcctgtaaattaaatgaggtaacagatttttaagcatttaaaaatcaaataacagacacccccattccaagacagctgaataggaacagctccagtctgcagctcccagcgtgcttggcgcagaagacgggtgatttctgcatttccaactgaggtacctaattcatctcactgggactggttggacagagggtgcagcccacagagggcaagccaaagcacggtgggacatcacatcacccaggaagcaaaaggggttgggggatttccctttcctagccaagggaagtcatgacagattgtatctggtaaatggggacagtgccacccaaatgctgcgcttttccaatggtcttagcaaatggcacacaaggagactatacccacacctggctcagtgagtcccatgcccacgaagccttgctcactgctagtgcagcagtctgagatcaatctgcgaggcagcagcctggcagggggagaggagttcaccattgctgctgcttgagtaggtaaacaaagtggctggggaagcccaaactgggaggagcccaccgcagctcaacaaggtctgctgcctctgtagactccacctctgggggcagggcatagctgaacaaaaggcagcagaaacttctgcagtcttaaatgtcctggtctgacagctctgaagagagcaatggttctcccagcacggtatttgagctctgagaacagacagactgcctcctcaagtgggtccctaccccagtgtagcctaactgggaggcacctcccagtaggggccgactgacactgcatacaggtgggtggctctctgggatgaagcatccagaagaaggaccaggcagcaatatttgctgtgctgaagcctccgctggtaacacccaggcaaacagtttggagtggagctccagcaaactccaacagacttgcagctaagggacctgactgttagaaggaaaactaacaaacagaaaggaatagcatcatcatcaacaaaaaggacacccacaccaaaaccccatctgtacgtcaccatcatcaaagaccaaaggtagataaaaaccacaaaaatgggaagaaaccagagcagaaaagctgaaaattctaaaaaccagagcacctcttctcctccaaaggatcacagctcctcacaagcaatgaaacaaagctggatggagaatgactttgatgagttgacagaagtaggcttcagaaggttggtaataacaaacttgtccgagctaaagaaggatgtttgaagccatcacaaggaagctaaaaaccttaaaaaaagattagacgaatggctaactagaataaacagtgtagagaagaccttaaatgacctgatggagctgaaaaccatgcacgaaactacatgacacatgaacaagcttcaatagccattttcatcaagtggaaaaaagggtgccagagattgaagatcaagttaatgaaacaaagtgaaaagagaagtttagagaaaaaaagagtaaaaagaaatgaacaaagcctccaagaaatatgggactatgtgaaaagaccaaatctatgtttgattggtgtacctgaaagtgatgaggagaatggaaccaagctgagaaacactcttcaggatatcatccaggagaacttcctcaacctagcaaggcaggccaacatacaaattcaggaaaaacagagaacaccacaaagatactcttattccaaaattgaccacatagttggaagtaaagcacccctcagcaaatgtaaaagaacagaaatcacaagaaactgtctctcagaccacagtgcaatcaaattataactcaggattaaaaaactcactcaaaaccgcataactacatggaaactgaacaacctgctcctgaacgactactgggtaaataacaaaatgaaggcagaaataaagatgttctttgaaaccaatgagaacaaagacacaacataccagaatctctgggacacatttaaagcagtgtgtagagggaaatttatagcactaaatgcccacaagagaaagcaggaaagatctaaaattgacaccctaacatcacaattaaaaactagagaagcaagagtaaacaaattcaaatgctagcagaaggcaagaaatcagagcagaactgaaggagatagaaacacaaagaacccttcaaaaaaatcaatgaatccaggagctggttttttgaaaagatcaacaaaattgatagactgctagcaagaccaataaagtcttgcaccatcacaagactaaaccaggaagaagttgaatctctgaatagaccaataacaggctctgaaattgaggcaataattaatagcctaccaaccaaaaacaaagtccgggaccagacagattcacagccaaattctaatagaggtacaaagaggagctggtaccattccttctgaaaatattccaatcaatagaaaaagagggaatcctccctaactcattttatggggccagcatcatcctgataccaaagcctggcagagacacaacaaaaaaagagaattttagaccaatatccctgatgaacatcgatgtgaaaatcttcaataaaatacccgcaaactgaatccagcagcacatcaaaaagcttatccaccacgatcaagtcagcttcatccctgggatccaaggctggttcaacatacacaaatcaataaacgtaatccatcacataaagagaaacaacaacaaaaaccacatgattatctcaataaatgcagaaaaggcctttgacaaaattcaacagcccttcatgctaaaaactctcaataaactaggtattgatggaacatttctcaaaataagaggtatttctgacaaatccacagccagtatcgtactgaatgggcaaaaactggaagcattccctttgaaaactggcacaagatagggatgccctctcttaacactcctattcaacatagtgttggaagttctggccagggcaatcaggcaagagaaagaaataaagggtattcagttagcaaaagaggaagtcaaattgtccctgtttgcagatgacatgattgtatatttagaaaaccccattgtctcggcccaaaatctccttcaagctgataagcaacttcagcaaagtctcaggatacaaaatcaatgtgcaaaaatcacaagcattcctatacaccaataacagacaaagacccaaatcatgagtgaacttccattcacagttgcttcaaagagaataaaatacctaggaatccaacttacaagggatgcgaaggacctcttcaaggagaactacaaaccactgctcagcaaaataaaagaggacaccaacaaatggaagaacattccatgctcatggataggaagaatcaatattgtgaaaatggccatactgcccaaggtaacttatagattcaatgccatccccatcaatcggccaatgactttcttcacagaactgggaaaaactactttaaagttcatatggaacaaaaaaagagcccacatatcccagacaatcctaagcaaaaagaacaaagctggaggcatcatgctacctgacttcaagctatactacaaggctacagtaaccaaaacagcatggtactggtaccaaaacagagatatagaccaatggaacagagcagagccttcagaaataacaccacacatctacaaccatcttatctttgacaaactgacagaaacaagaaatggggaaaggattccctatttaatgaatggtgctgggaaaagtggctagccatatgtagaaagctgaaactggatcccttccttatatcttatacaaaaattaattcaagatggattaaagacttaaatgttagatctaaaaccataaaaacctagaagaaaacctaggcaataccactgaggacttaggcatgactaaaacaccaaaagcaatggcaccgaaaaccaaaatagacaaatgagatctagttaaaataaagagcttctagccgggcgcggtggctcacacctgtaatcccagcactttgggaggctgaggcaggcgaatcacgaggtcaggagattgagaccaacctggctaacatggtgaaatcccgtctccactaaaagatacaaaaaaaaaaaaaaaattagctgggcattgtggtgggcgtctgtattcccagctactcgggaggctgaggcaggagaatggcgtgaacccgggaggcagagcttgcagtgagccaagatggcgccactgcactccagcctggatgacagagcgagactctgtctcaaaaaaaaaccaaaaaacaaaaaacaaaaaaaaacaaagagcttctgcacagcaaaataagctaccatcagagtgaacaggcaacctacagaatgggagaaaatttttgcaatctacctatctgacaaagggctaacatccagaatctacaaagaacttaaacaaacttaccagaaaaaatcaaacaacaccgtcaaaaagtgggcaaaggatatgaacagacacttttcaaaagaagacatttatgcagccaacagacacatgaaaaaaggcccatcatcactggtcatcagagaaatgcaaatcaaaaccacaataagataccatctcacaccagttagaatggcaatcattaaaaagtcaggaaacaacagatgctggagaggatgtggagaaataggaatgcttttacactgttggtgggagtttaaactagtttaaccattgtggaagacagtgtggtgattcctcaaggatctagagctagaaataccatttgacccagcaatcccatcactggatatatacccaaaggatgataaagcatgctactataaagacacatgcacacgtatgtttattgtggcactattcacaatagcaaagacttcaaacccacccaaatgtccatcaatgatagactggattaagaaaatgtggcacatatacaccatggaatactatgcagccataaaaaatgatgagttcatgtcctttggagggacatggatgaagttggaaaccatcattcttagcaaactattgcagggacagaaatccaaacaccacatgttctcactcataggtgggaattgaacaatgagaacacttggacacaggggagggaacatcacacaccagggcctgttgtggagttgggggctggcggagggatagcattaggagaaatacctaatgtaaatgtcgagttaatgggtgcagcaaaccaacatggcacatgtatacctatgtaacaaacatgcacattgtgcacatgtaccctagaacttaaagtatataaaaaaaaataaaaacaactgcatgttgtttcaattaaaagcaatctattacaaacaacagatttctctaaaaagtttaactttaggaaaatattgactctgaaaccattttggaatttgatgggctatttgaaaacatcttgaagattctggtttttatatcattattaattgtctttatgttcccctgttccagtttgtattctggataatatctggttctataggcaaattaatgtttaaaacaaaatgatcatctgagataaatgcttaagctgttcttactaaggggtttatagatacatatttttgaatatacaggtggaaatacatatttttactacaaatagaataatttatcttaatttgtgtatttttaagttattcactaaaaatataaagtagaatttgagagaaaagagagaaatatgttatagtgtgcccactagacagaattaacaggaacaaaatatacttacaaaacatttagaaaataaattattaactgtattagcatgagaagctcactggttcttctcagcttttgctctgcagagattatatttagctatatttttatatactattcattttcagtggctaggcagaaagatagattgatcttttgtggttcatttcaatagttttcaaatttagcttggacatttaattaattagcctttgcataatattaattgcttgtatctagaagaaatattttgtgtatgtgtttggctgataggttaataactgaattgagtaaataactgctgtcactactggctccaaaatgtgacattcatatttccttttttttgagacagtctcgctctgtcatccaggctggagtgcagtggcacgatcttggctcactgtaacctccacctcccgagttcaagcaattctcctgcctcagcctcccgagtagctaggattataggtgcccgccaccatgcctggctaatttttgtatttttagtagagacggggtttcactgtgttgtccaggctggtctcaaactcctgaccttgtgatctgtcgcttcagcctcccaaagtgctgggattacaggtgtgagccactgtgcccggcccgtatttgtataatatataatacttgattttggctaagtcttttcatgaagaaaatgacaacactgacactttgtcattcctcagtatctgtgggggattggtcccaggacccccttctgataccagaatccacatatactgaagtccctgatagaaaatggccatagtatttgcatataacatatacacatcttcccatatcaatcatctccagataacttataatacctaatacaatgtaaatgctacataaatagttgcatactatattgtttaaggaataatggcaaaaaattctgtgcatgttcattgtagacacaaccatccatttcttttctgaatattttccatctctggttgtctggattcacgaatgcagaacccatggatacagaatgccaactgtatagtcatgaggaaataatcaggaaaaaacagtaatattctaagtattacttaaattttggttttgaatccattttaacatttttttcctcctggaaagattttatgactaaatttatctgcaaattgtaatcaccaaaataggagttaaggatgcaaaattgtttgttttcattggtactgccaacattttgttattcctgagttcaaacggatacatttaaaagcctctgcaaccaaatgactgtgacttttagctcagtttctgtgagaaaaaaagacactattttaaatcatttttatttattaaacactagctctctacaaaaagcagctattatgatattacaggactataatgatcaacaaaactgtagtagttgtaatctgggcaataaaactttaagcataaactttggaagcagagcctgggtctaacctgataataccacatgtatgctgtgtgaccttatacaggttacttactctctctgaggtaaagtttcttattcataacatgatagtaattttacataaataaccagattaaatgagcaaatatatgtaaggcattaaatacatggtagctttactatttcatatatgcctcagagattcctggctctcaaggcaggagggagaaaatattagtaacattattactaataccagaaggaaaaaaaaataccaatagcatgaaattgaaacaaaatttcctagcactaaattttaaaagaaaatggtttttatatgagatatataggaatatagtacacatcaaataatgtagtggaaaatacatatttttagtgcaagtaaaataattttatgaaatcataatgaaataactattggaaaacatatgaaaagtactgtgtcctattaaatatgcatacttttgtttacacaagaccacaaatttatagaaaatttatttcaaaagctgagagttcaagaaaatcagacagtatataatatttgacctaagactattccactgataatacaagccgaataggaattattgtacactgaattgcaggatcatagctgaggaagacaaaattattatgtctgaatagaccattaaatgacctctgaattctttgacatataattaaaaataaaagcatatttatgccccaaaactaatgctttgtttaaataaaaaaagatgaataaatttactaaaataaataaacaagctaacagaaaaacaatcaaagatgcaaaaagattgtgttgtggaaatgcaatttgctaagcacttgaaaagatacatgggctgtagttattgtcacatgggcagttttgaactttcatatatgcacctaaacacagacacacacacaacagatattaacactatgttcttttttttcttgagactataaaggagctgtttctaaaagataagagaagaatccatcaaaaagaaatgaacacactgatacggtttggatgtttgactcccctgcatctcatgttgaaatgtaatccctagtattggaggtggggcctggtgggaggtgcttggatcatgggggtggacccctcgtgaatggcttagcaccatctccttggtgatgagagatttctcactctgagttctcaagagatctagatattgaaaagtgtgtggcacctccccctccctcttgctcctgctctggccatataacgcactggctctcccttcactttccaccatgattggaagcttcctgaggccctcatcaagagcagatgccagcaccacacttcctgtacagcctgtagaaccatgaaccaagataaaatatattttctttataaattacccagcctcaggcattcctttgtagcaatgcaagaatggcctaatacacaaaccaaatatggttttccatatttaatgggaggaatggaaggtgcgttactctttcttgaagagtttctctacattagacattttacttccaatatttctttaaaaaccttgcaacaaatccatgaaataggtattttcattctgctttgtagataaagaaactgagactcaaggagattaaagaactagtcaactattatacagaagagccagacttcattcccaggcatggttaaattcatgcccaggtttctctccctagttaaaacaagatttgtaataacagcaaaggtaaattccattagacacttttgctcagcttctagaatacaggcaatcaaatagtagtactgaataaagaattattgaataaaacgatacgtctatttcaaaagacagacaagtacagttgccccttctatatttggatatcaactgaagagttattacaaatgaattaaaggatttataaatgtctatggtattgttgaaggaagagaaaaaaatgcctttcaaacaatgtgctaaattatttaatgctgctcaaataggcgcctctgtcctttaatgcaaatacacaaacacacacacacacacacacacacacacacacacacacacacacacacacacggataccaccatagcttcctattgcttctgtaatagattacggcaaaattagtggtttaaaacaacaccagtgtattactgtatagtttgtaggtccaaatgggtctcactgggctaaaattaagacgtagcaggtctgcatttctttctagagcctctagggctgtatctgtttccttgtcttttctagcttctagaagctgcctgcttgcattccttaagcttagtgtcctttcatcagtcgaatctagcaatggccagtggattcttctgttgcatcagtctgacactgactgtcctgccttctttcacttataaggattcttgtaattgcattgagtccacccagatagtccagaataatcaccctatattaaatccttaatccaattacatctgggaagtcccttatcttatgtaaattaatatcttcccaaatttcagagattagggcatagatgtctcaagagaagggggcatcattctgcctacaagaggcatattattgtgttcttttcaatgtaaaattcgaaggatctactacatttaaaaacagaaatgtgttaggatgttcccaaatgacaaatttaggaaaaacaaaattctgttttaatacaaatatgggagctctcaagctctttttatgtgcaaacaacatcactgacagaaagctttaatggtaatactaatcactgagaagtttctggaccaagtgttttctgtgcattatttcaatttactcctgtaataacattgtacatattattgattgtccacattttatcaatgaagataatgaggcttggagggattaaataacatgtctaaaattactcaactaggagaaggcataaataagattcagactgaacccgtaacaacatatagatgtaactatttcactttatggccttaaatttgagtcattttttaaaaacctgaagtaatccttggatttgtgatttatggggagtggggagcaaggcggtttatttctatagtgaaaaaaataatttatttgtatttaggtattaggtatttaggtatatacttctatgcctaggaccacaagaaaaatgaacatttcactgggaaatttctaaaactttctaagtttttataaatacccaggaagccaagaatatagattgctagaatggggacagggaaagcaaacctacttctaaactgcatcaggaaaataatttaaggaatatgtagataatctggttggaattaaagcctcccagtggaagtatttctatatgccttcatttgaaaatatctctttcgctcacctcataacagcttgaggcaaagtaaaaacagtatggatacaagatgagaaatcccatttctataaagttgaggactttttcatcttgcacaaggcggttgaatacaagggcctgctttctcatgtataaactgtagacaaacaataagattactgtgatgattaaatgtcatcataaacaggtatatgtttataatcaccatacacctataaaacattagaattgtctataaaaagtgaaaagtgttatggcatatattctattttcaaaacatttgcatcttttaataaaaatagtggataaattatgtaaaagtgcatataagtgtatgtatagatactatataagtatatattaggatattacaatataattgaaaaagatatataatttaaaaaaatcaaaatcacgggatgatagattattttaattttcttcttttcgtattttatttttattgtatataatgataagtactgcttttctaatttaaaatagttaatgttaatgttatgatggaagactagaagtagagcggaaacagaagtcataaagcatacgtacacgaaactcttgaactttatctgttcctttctatgccttttctaaaatatctctttcatctaaagaacctgtggagatactatgtgcaaatcttcattttcttttcctccatcaacaagccctggcttacgctagtaaagcatacattttttttcctcctgaaataaaataagaattttcctgcttgtttgcgaaatatttccctaggtatattggatttactcgtgaagattcaaccaagaagcaatgaataaagagagaagtggccttgaaaaacacagtctaattattatttatctatatatctttgctgtgttcattagtcatatggtatacaacatattaaataattcattttttgcacaaattttagaagtaatataagtggaagcaatttaactacaactacttagtgtaatgaacattttaaattgagcttttggaaagtgcttaattaatacttgtaaaataggggttcacagttcttgcaatatgtcattaagtccaagcattatctttaatcttctcccaaacttctgagaggagaaaatagtttttgaagcaacacaaattgataaaccttcaaaagttgaggtaatcagctacttacatttttgagcactagtcacagtataaatggaaattaaaattccattatgacataaagtaaaaatttagcactgtaagtttcaagtaatatgccacccctctacaccaaccttaccaagcacttcattcaaccacatttcagccctaatatgactttttttttatttgcctaaacagtatcacttcctcctttattttggcctcagaagtccattttccctccttggtttactattacctccacattccatgagtccttaatagaaatgccaactattgtactcttcacttcacccctggccaaggatacacagctcaagccaggccaatcagattctctcaccttcagatgtgtgatccttgaactgactgccagttgcttgaaggtcattgacctcagctttcttaatggcactgcccaaaaaggaattgctacttgagtttctaagattgctgaagcctctccatgtttttgtttttccttagaccctattcaatttctctcttgctgtacaagccaccaagtattcttctgatatgattcctttagtataagccagtcagaagtggtttctgctgtttccaacttactaaccatgccaaaaatagtttggaatgaccaatttagttcatagcagagaatggacaccatacctccctatttatggaaaagatactggattttttcctcccaaaagacattatgaaatgtagatttttcattttgtgttgcaaaatttaatcaagtattaaattttagtatattttcttttttataatcatggattttacatcattttaatttttttttgaagaaagttgtctttgtttatgtatatacattatccggttgtcaatcaaggtaggtgtattcaaatctaaagccctcagaagatgcctggctgcttttctaacatgtcacaacctacaatccctggtaatacagagaattcagaggaaaatatgagatatctctctgtacacttatctaaaggagtagatgaagcatatttagtatgtgcttattataattttgtgtggttcgaacatatcacagctagcagtagtaataaaaaatacctttttatagagtatttcttatgttacaataagttaagtacttttctgatatgatagtccttaaaattctcaaatacccttatgaggtgtagacatatttaccctaagagaaagttgaagattataaaggttagagaagtttgtaaagatcagaactgggtatggaattcaggcctgtctgataccaaaatcatggatcttaagtaatttcatatatacaatttttatgtatctactttttctctgcttttctattaaggtaattttaaatgggaacaacttaatggtttaataatctgtgttacatagaattttccctagtatagatttttgataaaatttctcctttactgtttgtcctttaaactcaggcatatctgagcatttatgaaatatcatcaaatagggatcatttagaagcaaaactgaaccactaaactggttaaagtatccaactttcttgtgtattttaataaaacacaaatataggtcaggtgtggtggctcgtgcctgtaatcccagcactttgggaggctgggggtgggtggatcacgaggtcgggagatcgagaccatcctggctaacacggtggaaccccatctctactaaaaatacaaaaaataagccgggcatggtggcgggcacctgtagtcccagctactcaggaggctgaggcaggagaatggtgtgaacgtgggaggtggagtttgcagtgagccaagatcgtgccactgcactctagcctgggtgacagagcaagactccgtctcaaaaaaacaaaacaaaacaaaacaaaacacaaatatagcaatctctattaaacagtcttgatggcaagcatatgctgtaagtaaataactagtaacaggctttcaaaattgaaagtgacagcttttaaaataatgatttcctctaaactgcttgtctgtaattatttttaagatattacataggggactaattaggtacaagataccaaaagggataagaacaggaacaagattgattaattgaacttacgaaagttcctgggaataaaaaatgaattagattgggaagaactgactacgagacttgtgttctgaataatgattaaaaagaatgacaagctaaatttatgtttcttatctctgaatcataaaattctgtttttgcttttgcattgaagcaatgtgtacattaaattgaaatgcatgccttataaaatgtaaacattaacaaaattagggaatatttaagaataaattaaattttaaattgtgaagataaaaccaagaaatcttctacctacttaattcccatgttttcttccacatacaagccctttattatttatttggcactagctatagttattgttggcccaagttaactattatccaacatactttctttagtcataatttttctggagtatctgcaacatttgatgtttcagccatttttgacttttcttgaaaccctcttctcctttggctaacaggtcatcactacataaattgtactcattttttccactggtctcttaaatggctattcttttcctctcattcactaaatggaagagtttttctcaaactcagtctttcatttttctctcttgacagcctcagaaagacaaatgagatggggcctcaagggacaataatttttttttcttttgacagcttaatttggtcattgtgagaggttacagcctgctggcagccctcgcagccctcgcttgatctcagcacctcctcagccttggcgcccactctggccgcgcttgaggagcccttcagcccgcggctgcactgtgggagcccctctctgggctggccaaggccggagccagctccctctgcttgcggggaggtgtggagggagaggcgcaggcgggaaccggggctgcatgtggcgctcgcgagccagcgtgagttccggtgggcatgggcttggtggactccgcactcagagcggccggctggcaccgtgggccccaggcagtgaggggcttagcacccaggccagcagctgcggagggtgcaccgggtcccccagcagtgcaggcctgccagtgctgcactcaaattctcactgggcctcagctgcctccctgcggggcaaggcttgggacctgcagcccgccatgctggagtgtccccccgccgtgggctcctgtgcagcctgagcctccccaacgagcaccaccccctgctctgtggcacctggtcccatcaaccgcccaagggctgaggagtgcgggtgcacagcgccggactggcgggcagctccgcctgcggccccagtgcaggatccactaggtgaagccagctgggctcctgagtctagtggggacttggagaacctttacgtttagctaagggattgtaaatacactaatcagcactctgtatctagctcaaggtttgtaaatgcaccaatcaacactctgtatctacctaatctggtggggacttggagaacctttatgtctagctaagggactgtaaatacaccaaatcagcactctgtgtctagctcaaggtttgtaaacacatcaatcagtaccctgtgtctagctcaaggtttgtaaatgcaccaatcagtgctctggggttttggagaacttttgcgtctagctcagggattgtaaacgcaccaatcagcaccctgtcaaaacagaccaatcagctctctgtaaaacagaccaatcagctctctgtaaaatgtaccaatcagcaggatgtgggtggggccacatgagggaataaaagcagactgccccagctagctgtggcaaccagctggggtcctcttccacactgtggaagcttcattctttcactctttggaataaatcttgctgctgctcactctttggttccacgctgcctttatgaactgtaacactcaccgcgaaggtctgcagcttcactcctgaggccagcgagaccacgaacccactgggtagaatgaacaactcctgatgggaggaacgaataaccccagacatgccaccttaagagctgtaacgcttaccgcgaaggtctgcagtttcactcctgaagccagcgggaccacgaacccaccagaaggaagaaactccgaacacgcccgaacatcagaaggaaagaactccagacgcaccatcttttagaaccctaacactcaccgcgagggtccgcggcttcattcttgaagtcagtgagaccaagaacccaccaattccagacacagttggatctgagttagcagaatggatctaaacagcatttctccctgatacaagcttcactagctcatctcctcttaaagagatcattgcctcgacagggaatctcctatcattacactgccagtggatttttgtttgcctttatttccatatttcctttatatttgtagagtaatagtgtttccagtccctggtttctagtcttgagccctttctatggtgtgttcagatgtgtgcaaattaagtttttttctttgtgcttatgggaggtcaagagatactttttcctttgatgctttctttgcctggttttctcacttaagcctcattattttacatttgtaccacgtgagactagcgacgcttggcataacaattccttgacttaagtactcatgctatatgattttttttcaaaacctacctgtcagtcttgaacacctttggaagtccagttccttgtttcctgcaagtttttatttagatcttattcatgtcacccaagatcaaaagtataaaatcatccttgatttcttcctttctctttataaccagtcatcaagtcctaccaacttctcttttgcagttgtcctatattttcctcctctcactggcccaatcctagttctagtttgggactggcctatttatccaattctttttagcattcattctatctctctccaagctattctacatactgagctaactttctcatgttaattccctgctttaagaaacaaaacaaaacaaaaaactgcaagcagttaatcttcctatcagtatttcaaatagttgtgaagaaacaacaacaacaataaaaacagtaaatattcagatttccattttccatttccagatatcttaattaagtaggtttggaaaagagatcacaaaaatatgtattattaaacgagtatctcaggtaattatcaccaggtagttcaaacagttgctttatgagaaacactattttatgattcttttacttatctacttcctttttctcttcactaacttttgtttaccactagggcaattcactgtcttctgaagccactttcaaccaattgccaattagaagaattttaaatttatacaaccaagctgcacctcaaccaccttgggcacatgttctaggatctgagggctgtgtcaagggccatggtcactcatatttggctcagaataaattgcttcaaatgttttgcagagttcgaggtttttcactgacaaagctactctaatttcaaatcatgcatgtctatgtctcttgtatatcaattagtcatgtacttcatgctactacttattgtttatacctatgttatagcttctccaccaggatagaaacttctttaaagcgctaatctcaccttgtggatacgtatccccttacagcacttagaacaaatatgtgatatatatttgttaatttaacatacttttcattatctctgtagcacaaaaataatgtttcaggggccatgtgacaaaaaaacagaatcatattagatgtgcctcaaaaataaagggaacagagttgttgaaagtgaaataataacttaaaaagtactagtctgtttggaagttttgtttatatgtaaatgcaagtgtgtgtgtgtgtgtgtgtgtgaatgttaacattagtcaaagagtaagaagaattacaaggggacccacaaaacctttaccaatccatgtaatgttgtcaaagataataagtaatatctaatttcaaaatcaaaggagcattgtcccagtcattctttaccacttttaccttttaccttggaatacactaaattccattgtttgcccatgtatctattattttattaccactttatatgtttaactcatcaaatgttcttgcaaatctgatacaattcacaattcactgtgaagaattataaaattatactgttattaattagtccaggtcaaaatcagatccattttggacaaaatcaatcatgaaaatatatggttaattataatgtgatcttttatataaacgataaatatcaaaaaggtggagtagtacaacaatagatattataacagcgtttctttgaaagcattagaacatggcatcaaacataatttactagacaaattctgtattgtgcaggaaaaggagtatttactattttctgaaatacatctttcatcttcatagtgttatctatactattctcttctttgggatctatctcacatttttatcttctctgctatcatccacacagcacctgtgataaaatctgggacaaaataaaattgaataatactacatctttttatttgaggagaactcacaggccagatgtatttgttcttgtatgacagggacaatgaatgattaagcaaagtctcaaaaatgagatgacctttaaactgacccttgtagaataattgagttgatctgaaaaacaatgtagaaaggacattttaaaaagagagacttgtgcaagcaaagacatttaggtatagacattccttgaggttaagtgaaaagaatgcaatgaatatagaaattcagaaaagcagttacataggatatgcccagtagaacttcagagactggtgaagttgagacaatgaaaccttctgaatgttcactcctatgtacatcttttctatatggcacttttccccatatttctttttattatgtaagcataatgctgaatttattttcgtctatttaatgagaagctttttttttcttctttcgatagtcaaccagtaagatcagctacttgttaaagttgggaaaataaatattttactaacagaaaaaattgcattatccataagtgataaaaataaataaaaaccaatctaataactatgctaaatctttagcaagttattactttaagtgcagacctgaccttgattatattacaacagaatggggatagccaatgcctacaaccataatcaataatgaagaattaattctgataatttccctcatatctatcaatgttaaactacattttatgcttatgttattcatgtagttgcatctgttttctatttctgcaaaggttgttatttctgtaacataagtgacttaatagattccagttcttctgtgcatagtttcatttgcatttaatagggcttagtgtgcctctactgaaataggagtttttctaaagcaagaggtttagagtgactgttgtatcactttggggcctcattattaatcagtaattaatactctctggaaagcataagtttgccaaaatatttggcattcaatgaatggcattttgaatcccaatttaaatttggactaaaaaggcttagaaaaaaaatctaaattatttactatattaattataagtacgtttccaagaatgaagaaaactgtatcttctctctttagttccaggcttattcttaggtataagaaggagaactattttatgcattcctagattcttaaatattttaattttgcttgcccatggcagcaatatgtttccgtcatgaaatatatattttttctcatatatgcagaaatgtaatatttttctattttgaaaagtctgattatatatcattgtcatcagttcagcaaaccaatttgggatcaatggaagagcactgcctcaatgcatttggtttcagaaatgtattaataatagtgtataccatgtttcaaatcacatttccaaggaaacctattgtgcacaatgcaattttttcttggacagacaattttatgctatgagtccactggaatacatttttgtttcattgaaaatataattttttcaaccatatatttatataagatgcctaaaatttctgaaagaaaaaatgctgttaatgatattatcgtgttaattttcataaactcctctccatattttaaagtaatacattattaatatagtttctaaaacagtggccatatatttgtactataaatataaggctatgatcattcctgggattttaggactaaaaaataatatgtgacaggctacaatattgttacccaagttatagcagggatacttttgttttaagtcagtcaatcataggtaaagagtcattagcattatttgtcacagaccttctgttagaaaccacaaaagtcagaagaatgaaatgtattacaagcttgtaccctacagctaaaacataaaatgaaatcaatagcatttgagttgttttaccctcagtttaaagtttatcttaattgtcttgtaatttattcctgattgaaagtctagttattgaatcaaaacacaatgacatatttatagaaagctatggctttcttttttcatgtttaaagataattataattttaccataaagcaaaaattgccacttcaattatggagttacataaatcaatctgtgctgtaaacttgcatgttactgcttttgctctacataaaagaatgggaatgactctgtggcacaaatattaacataagcttctatagatgttctgggtacaggcttcttgaagcttctttgggaccaagtaacattatatcctaaaaacccaggagagtttgagtttttctgcaaagaaagagactatggataggaagaaaagatgactcataattttgaaataatgtattagaaatagcaacgcattcggctgggcgcggtggttcacgcctgtaatcccagcactttgggaggccgaggcgggcagatcacgaggtcaggagatcgagatcatcctggctaacatggtgaaacctcgtctctactacaaataaaaaaaattagccaggcgtggtgtcaggcacctgtagttccagctactcgggaggctgaggcaggagaatggcatgaacctgggaggcggagcttgcaacgagctgagaccgtgccactgtactccagcctgggtgacagagtgagactccctctcaaaaaaaaaaaaaaaaaaaaaaaaaaaaagaaatagcaacgcattcacatttgtctttccttttgaaactagtccaacagtcccacagacagttgttttcagataaacacagagattggctcttctgctgctaaagcttaaaacttttatttgttttatctgagctctttcctcagcaaaggaggaccttcaggcctctgaaaaaagtttcagttatttgaaacttaccagatcactgccccagaggcctccttgctcctccccagttcttgttttcttacactcttacgtttcttccctactacataaaccccctagctttagtcaatcagggagatggatttgaaactgaactcccatctcctcagcttcaacacccgattaaagccttcttccttggcaatacttgttttctcagtaattggctttctgtacagcaagcagcaggacctagaccaaactcctggtgtttcattaacactttgtaaaaggaagataattatttgatcaaattagtggtcaatatgggagtaaaggaagaaaatacggatgcttaacagaatgagacaggaagaagagataaaatgtagggagtctagagggccagaaagtttgagtgcaggaagaatgaaaaatcaacacctaatttctaactgaattgaagagagagaaaactccaaagcttttcagattccctgcaatttcaagtactgggaggaagctcctaagcacattcccatgattaaaacagtgtactgtctccatctgtaataatgactaaaccactgttatgaaaaggctgcaaatcaggggtggtgaggtgggagtgggcagaactggagcttagttagcagtcagccatcaggtggattgtatgagtggtatgtatgctacaaatttgcatactgttagcttgatatttaaaacgcttcacaatctggccttaattttccagactcactcatgcattggacaaatctttattgggggtatttatgtgccatgcattttaggctattgggatacatcaataaacaaaacagatacaaacttctgtcgttgcgcagactaaatccattttaacaatatccactaaattctgttctacagtctcactgaaacaatattcttaatatgaaaatatagaattataaaactctattattttctttcatactatctctttaatcctgctaatatgggctaatatctttcctgctgttgaataaaagctcaagaaattttataatttttaaaaaaattgttaatagtactatggtaaaggtaactttaaaaagaatttaaaaatgattctctagttcaatatatgaatctaatactccaaatttcatttaaaggtaaaatgtccttccccagcttagatatgttaatggaagttcctctgcctttggggaagaggctgtaagagatttctttttacttttttctttattaactaccaccacctccttcattcactagcagttgatttttatcactcagacttctattacctgaccttggagattatggagaaaaggcatgtaaggtaggtagcgaagttcctacttcaatattactgttgtgaaatggctgaatactctttgggtcagacctgggtttaaaacagacatggtcaatgagagcatcttcagcactggtatgcttttcttcagcaacttcagtttgccagcatacttcagttaattccagtttgtcattttataggaattctgcggtctatgtccagtttttgccttttgcagtatcatcactccttcaggtaatcctaccgaacaggatttaagaaaactggcattcacctgtgtcccaaatctggtcctttgggttggtttgggtataattatgcaggcaaagaacagtcacaggctctttgcctgcatacttatagaagcacagacctttctagatgtagctgtaatataatgtaatactccagtcattgtaattgcttgttgctctttttctgtctacatttatctgatatgtctcaaacatggatttgctgtgctaggccaacataagggcagcgttttttactgtagttgccaatgttaaacttgagaagggaaagcatatatttccccagccattgtattttggggaaaagtatactgttgaagtgaattcaagtacaactttacaacaaccctcccctataaaggaatactcatacaaagtcacttctaaattttaattcgcgtgaccattttcaattctcctcgagagtaatggtgttcagagtgttaaactctgttactggaacatgatggttttggtctaggttctgctgcttgccacacagatgggcaatcactgagacaatgagtattgctagggaagaaggttttaatccaatcgggtgctgcagctgaggacatgggagatcagtctcatggagacagatccctcatggcttggtgttgtctttgccatagtgagttctcacaagatctggttgttgaaaattgtgtggcaccttcccccaccactctctctctcccttgctactgcttttgccatgggatgtgcctgctctccctttgacttccaccacgattataagcttccggaggtctccatagaaccagagcagatgccagcaccatgcttcctgaagagattacagaaccatgagccaattaaacctcttttctttagaaattacccagtctcaggtatttcttttttttttaaattttattattattatactttaagttttagggtatatgtgcacaacgtgtaggtttgttacacatgtatacatgtgccatgttggtgtgctgcacccattaactcttcaattagcattaggtatatctcctaatgctatccctccccccttcccccaccccacaacagtcccccgtgtgtgatgttccccttctgtgtccatgtgttctcattgttcaattcccacctatgagtgagaacatgtggtgtttggttttttgtccttgtgatagtttgctgagaatgatggtttccagtttcatccatgtccctataaaggacatgaactcatccttttttatggctgtatagtattccatggtgtatatgtgccacattttcttaatccagactatcgttgttggacatttaggttggttccaagtctttgctattgtgaataatgccacaataaacatatgtgtgcatgtgtctttatagcagcatgatttataatcctttgggtatatacccagtaatgggatggctgggtcaaatggtatttctagttctagatccctgaggaatcgccacactgacttccacagtggttgaactagcttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatatcttcttttgagaagtgtctgttcatgtccttcgcccactttttgatggggttgtttgttttttcttgtaaatttgtttgagttcattgtagattctggatattagccctttgtcagatgagtaggttgcaaaaattctttacagtaatgtgctctaatacaaagagatgagcgagaaaatgatgaaaagataagagaagattcaacacttgtatactaggaatctcccagtgagacagaggagggatagaactttgggttcagatcacctctactagagcattatttcatgcagtcacactagtcaccagaccttgcaccactgtaaggtgatggcagcatcacctcactcatgccatccccactgaccacaagactgtgcaagctataagttacctagagaaactaagatgagggacattctaccatacatcttactcaaggaagttggcccccaatacccacatgcacagaaggctaaaaaaatgactgtggtggcaggcgcctgtagtcccagctactcaggaggctgaggcaggagaatggtgtgaacccaggaggcggtgcttgcagtgagcccagatcacgccactgcactccagcttgggcaacagagtgagactctgtctcaaaaaaaaaaaaaaatcacacggagatgtaacatgttaatgagacgtgtgacacatgaagaagcaagtcatcaaactgtgcaaatgctataaattcccatttctacatgctttaatgtcactcctttcatggctaggcctgttaaaattactctcttggctatctccagggaggcagcaagagcactttctcttttccgggctgctttccttgtgctccagcataagttccaataacgcctggagtctgggaaattttcttagccttctgtcagtttctattgcacaagagcataagaacttgtggccagtaacaccagaatagatgccacattaataaaaaaaaaaaagtctagaattaaaaaaaaaatccctaaatgagacttgaacagttatactacatatatagaaaatgacccagaattgccaacatgtagaaatacattgacaaaaatactgaactctaaagaaaaaataaaggcaattatttggaaattcagaaataagaccagtttgtcattacacatttttttacagtaatgcttcaaagaataagaaaatggaatgaaaaatttaatttaaaaaaagaaaatgagtcaagttatccagtcaaattggtcttcaatgttaaagccctaagataagcttttcttaatgcaccaaaacataggaaatagtgtctctataatcctgcatcaaggactttacttgggaatgggttactgataacaaaatgactgaattgtgttattaagagggataaaacaatatcactttcaattagatgtgtgggaaaatataagagatgaagcagaagcattgctcacaacaggaaacatatgagcagtgcaaaaaaaaagtgtaccatgtaatgtaaaagtaagtcgtagaacaaatgtgggcaaactacagccctttggtcaaatccagcccacagacagcctgttttagtaaaatgaattttatgggagcatagccaaaccctttggtttacgtattatctcttcttgcttttaagctacagcagagtagagtagttccgacagagaccatatgacccagaaaactaaacatatttgtcatctcagtattcccattttgagtatgatagtgaatcaactcattattttgaaaatcaataataaaaggaaagaataaagtttttttttcttgtttttcctatagttggtggacctcagggttactgagtatttgctatggagacgtttttctttataaaaatattttggctaatgaatatagaagtaataaaaataaaaaaataatggatttagaaaattactattggtggttgctactatctatatcacaaaaagagaatcaaagagatttaatgtttaaggaaggagtgaatatcacctatgatttatttgtttaaaaacaaaccaaaaataacctggatatgatcaagcctccagatctaactacttatttcctggaaattaaggaagcagaaagaatatgaaatgaccacttggagagacagtcatcaatccaggcttcagaaatgtggtttcttgcacaaataaatatcaaggtgaataaaagagcgtagtggtgaagcctacagattaaaagagacttaacagacctatcaaccaatggcaatgtatagaccttattttgattctgatgtaaataaatgttcaatgtgaactggatatgtttaatatgaactatgtttaataccaactggatatatattgatatcaaataatttgttacttttggcagcagtaatcatgatattttaattgttttaagagtccttaagatatacatatcaaaatatttacagattgaatgttatgactctgacctgcttcaaaataatgcaatagtgggtagttgagagcatagaggaacaactatttcccagggcgtgattatgttgaattagggagttgatacatggaggttcaccgtaatattctctgtaatttttgtatgtttgaaatgttccaagtaaaatgttaaaatatttaaatattcctagtgttaaacttatgaaattagctctaaaattttacattttaattaatttgcatttaaatattaaatctaatcacatcatggttgcacaatttactttgaaaataatttcattaacaaatttttggtaaagaagtcacaataaaatacttctttaatgaattacacttctgatttttattatccttattcaaatgatatgtggtagggcaactaattctgctgcagagatgaatatttagctaactaattaacctcaatttacataatggttgtatttgcataactaatgggctggggattgactataggccattaacagttattaattaatgagattgaattagaaatatatgggtttttatttcaaacttaggaggcaaaggtcaatcataaaaggttaataacaatattcaaagaatcaggcagtaaatattttagcttttagacttcatgcatttctgacaggataattcaggaattggtttcacctctacatgcatactggggcacatggaagtatacacatgtgcattagagaaacttttattagcctcagatttacatgtaaattaaagtaatgggagctagttgtattcacatataagaacttaatgcacctctattcataaaaatcacaggtatcacttgagaaagttctacaacctaaaatttttctttcttaaactgttcatttgtttcaaggaaagagtgcaggtacacttttcaattaatcttcctcatttttgcatttgcaataaaataggttacattatataatttagagttactccaacctttccactcctcatttatccaattcagtttacaattggaagcatcctctatatttttaaaaacataattgcctgtagtttaaagattttagaaactcaaagaattcatctgctatttttaaacaatttaattatgtgagtgatgcataattattgaggacaattcaattcctttaatttcaaagacacctgtataatctgatttttcaaatgatttggttgtatctctacaaggaactgagcagctctctacactgaatcagtaaatgaggttcacgataaatgaaaaggagtgatttctttttatgatcaactgccaaactgatacagaaaattctgtcctgcatcttctgcctgttgctcctgtcttgctttcttttctctcacactgcctgggttcttgctttatgcctctgccctcttctttttccctcttctcccttctaagaacgctcgcttgctgaaatgccttgaaatgatgtccagggatagtccctgggtgaatgtttcagatcctgtttctcatttcacactctgtctgggcctctattctattaatagttaacttaaactggattatcttgagtcttctagattttaaaagggttgctctgattacaaaaagatgattgcttaaatgcaaaagagtattacctcaatagatgggaaaagaatagcatttattgcattattgataacatctttaaatctgtgtcagttcccttcacaaattggcttttatatgcttctctgtgggggtaaactatatgccacagaaatgttgaagttcggagtcacagaacgtgggcttaaatctgtgacgctttgtttactgtcatttaaaaaaataacctttttaattattaacaaaatcttgcctttgtaaaacagggtagtaattctcatttcatagattaaaagtgtaggttaaaaagtgtaaattaaaaatgaaaaatgatgctacatataaattacaataaatgttagtcgctaattttaagatgattttttcttttctcgaagaaaatatgtaaatacaagaagccacacaattcaggcaatttctagaagtcattcattaaaaatatctatttcccaaggtttatccagagcttcacagtgggactaagttttattatttaacatacacagacaatggtggtattttaacaatattggatacacaatttgaaaacggtgttttattatctcgacatttcaggagtatgaaatcactccctgccttgtcatatattagctgtttaaacgaataggcaatcatctcagagtattaatgatctttctatgttgtccactgagaatgatattttagacataggtatttcatttaaaaaattagcagagacaccatacaattctggtaaaagctttaagtagtataacttactttttgaaggaactcggagattggcaaggaccacttccagggaatcagcttggactcgaagtacatagcttgtcctggtctcataatccagaggtccattcacatagataacacctgtgatgttattaattccaaatgtatctagaaattaaaatacaattacctggtcattgtctttacgctataaggaaagaaattctctttaaaaggcactgtgatttcaaaaacactaaaaatgcctatttataactagagtgatgcatgaaagtgacaaaatgctggcttttggaaactgttccagctctttgaatgatcaacatcaatacttcgctaaagtctgccttgaaattgtagggtttttttgtttttgttgttttgagataatcctggaaaacaaagttctatggtcaattacatttgggaaacactgaataatatattctttaccttagattcagatggtcttctgtcacactaaaggctttcagaagttgtttcaaagaaaaccatctaattttgtttaaccaaaattttctgaacttactggattattatactctttgtaatttatgaatattattattttgtagatttagtgttttgctaagaacacttgagagaaaataaaaaaatggataatttaatgttgccctgtgtctgtttatttaaataaatttgaatgaaaatcagggcactttggtaaactttataatatctccccctcttatgctctccatattctctccttactttattttttcatgtaattaataatcccttataatactatatatttctttgtttaataatttttattattaatctccgcttactggaccattaacttccatgagggcaggaatctattttgtacattgttctatctgtagtggctagaagagtagttaatacataatagatgctcagtacatatttgttgaataaataaataaatgtacaacagtcactgtgggggacagacgttaataaatatagccactctgctgtcttcaaagaaaaggacaaatagaatcaaaagagaaagtttcgggacggaacaggttgagaaatcatagctttagtcagatgttcgaagtccaaggaaaaaggaaatttagttatttttagggaggacacatagtagcacagtaataatgtagaaagaaaggcaataaaagtaagatattgaccacttgctacactacacgggcagcaatacctagtaatagtttgtcattaaaaagcttaacagggcctttataatttccttgcaaactcttttacattcactcatttctttaatatttactattgattaacttattacatgtatattaactatttcctgactacctacaatatactaggctatctaacataccaaaagggaaaacagaggagaacttgtggagaacaggtaaaacaaaaattaatgcgaaagattgagctatgaccttattcccagaggcctgcaaattcctatgattcttaaattacaaaaacttatatttttatttttaatcatgaattgtatgtctaatttgactattttgggaatcatataacatgcatagcttttaacatggatgtgactctttttaaaattcacaacttatttacaaccttgaagttccttcaggattagttaaggtatgaccaacatggagtaagggtcatggatggttcagacactggggcggacgaagctactgtaggcaatgatcatggccaaaagctgaaaatttcatgatgcattaattttgaggaaatgtcattaaaatattaccaaatgaggaaaagggcaaggtttcattaattagatacttaatatttcttaaggtacttaatatttcttaagggaaaaaatcactttagctaacatcactggatttttaatcgagttcaggatacatggttaacaattacatttaagatgggcacaattttattagaaaacaatagaatagataataatttcaattcaatctgaaattaggccaaatctaagtttactggttgatggtgagaacacaaactaaaagtctactcaccttcttcatttcctgaaacaatggagtacacaatactttgattaatggcagcagcagaaattacaccaaccatggtccctttggtggcaagttcacttactggaggaggtctgcaggtttagagaagatgatgtatttatttttaaatataatttttgatgtaactttacgttcacagaaaaattgagagaaagataagagatttctgatataccctctgccctcacacattcatggcctcctccatgatcaaatcccccacccaactgctacctttgtgataaatgatgaacctacattgacccattatcactgaaagtccatcatttacatgagggtgcatattgttgttgtacattttatgagtttggacaaatgtgtaatggcatgtatccgctttcatgtagtatcatatagggtattctcactgttctgaaaatcctctgtgccctgtatattcatccctcccctcaactcaacctctggcaaccactgatctttgtagtgtctctatggttttgccttttccagaatgttgtatagctggaatcacacagtatgtaaccttttcagattgccttctttcacttagtaatatgcatttaatgctcctcaacatctatggcttgattgcttatttcatttttagcactacataatatttcgcggtctgaatgtacccacagtttatttccataaataaaaaacatcttggttgcttccaagttttggcaattatgactaaagccactataaacatctgtgtgtaggtttttgtgactctaagatttcaactcttctgggtaaatactaattagcatgattactggattttatagtaagactgtttagtcttttaagcaactgccaaactgtcttccaaactgactgtaccattttgtattctcaccaacaataaatgagagttgctgttgccccatattctaaccagcttttggtgctgtcaatagtctggatttcagacattctaataggtgtgtggtggtatttatttttatttttttatccatatttatgacagagttttgaacttaatagaagaatgtacacggtagttcttccaagctacattatgcaattacattgtgctttcattgaaaccttttacaaaaaatcctgaaatacaaatttagtctgaagtataggctttataaatatctggtccaaattgctttgtttttggtactgctgtccatacacttaattgactaggttatctaaatgtaaagcagtctttctcacagatactctagcacctaatggtggtccatatattcattgcatgagcaataactgcttcttgctgaagaataagaaccaatctgtatcattttaaaatgaagtgtgtaaagtagatatttaatttactagtttatttacttacttattttactgtcctgcattttctttttgctttcttttgataacatccaaatattgttttcaataatcttgcctctttccttctctgtacaagtgctttgggtaaggctttgccaatccccatggtacatgcataagcacattaaccaactctggtcaatgggggcattttatcctttgctcagtgttcatgtgatgtatacgtctcatgtaaattcaatggacatactacataagattatgacttgactagattctcgctagccaactttttgggtatatccctcactggatttgatgaagtaagctgccatatggagcagtcctcgtggcaagaaactcaaggtgatggctgactaacagccagcaaggaatcgaggcccttagtccaacatcccacaagaaactgatttctgccaacaaccacatgtacttggaagtggatctttctgcagttgagcctcagatgagaccgtagccctggatgacaccttgattaaaagattatgtaagtccaaaaaggagaggacacagctaacccatgcctggattcctgacctataggaaattcaaaatgatatatgtgttgttttaacccattaagttcatggtaatattattatgccacaacacaaaactaatatttgaacaatggattgttaatttatgacagatcaagatacatactacttatcaaaagtttaatacaagaaaatatgtcagtcatattaggggataattttcaaaaactgaattcctatttgtggaagtagacattacttaaattgtttacttgtctatcttgttactgcacaagatagaagctaaattttatactttccataattcatctgtttgctattccttatacagtatggaaacaagacgtctgcaacttatgcacctttagctttaacatgagaaaaatgctatgtcgggccgggcgcggtggctcactcctgtaatcccagcacttttggaggctgagccgggtgaatcccctgaggtcaggagttcaagaccagcctcaccaatatctctactaaaaatataaaaattagccggttgtggtggtgtgctcctatagtcccagctactcgggaggatgagacatgagaattgcttgaacctgggaggcggaggttgcaatgagccaagatcacgccactgcactacagtctgggcaacagagcgagtttaaatctcaaaaaaacaaaaacaaacaaacaaacaaaaaaaacaaaacagaaaagaaaaatgctatgtcttctttcaaatattaaaaaatgcacgtgtacatttttgctaaccttaactgcacaattaggatagaaataatactaaaaaaagtaattggcataatttaagaagacatttaaatcctatgcataccactaaaagcatttaaaattctatttgttagtaaatgtttacaacagatttacttctagacaaaatttctcctcattaacctttgtcttaattgttccagtacacttgtttctatcagaactaaaacactatacaaatacaatcttctcccaaaaagaattaaatgaacctccatgataatgagcattagattaaaaatatcaattattttctattttttggcaggattacaatgtacaatattaataaaaataatattattttattattgttttaggttgtggaaagtaccagttacatgatggaggcaaattgcatactctctttggagtcacatatgtcttgaatacaaatgatggagttggtataaatcaggattcattaagccagatggacagagaaggtaggaacataaccaaattgaataaaatgggctgaatataaattaatagggagaggaatggaagttaggaatgagagagtatgtaactactgtacaataattcaagtctggtgtgatttgtaaatcaataaaggaaattgaaaattttgtatatgtttatgaacgatcaatgggaatttatttttttaaagcatcaatgactacatttgatctatgggctgtcagtttacgatttttaaagcagattaactatctctaatgtcttttctagttctaccattctgaacctgatataatgtgagttatcattcactcttctttctgttgagtataatcaaaatctattgctcaatttcagaagcaatgaattatggccaaatgaaacatttctcagaaggttttctaaaaaaatattttctctattaaattcataaatcttcaattcatccatttatgaaaaaaatgcatcactagctctcttccaatttaagcttttcgcacctgatttataacaaataattgtgagtgtctgaaatggaagaatactatctttcaaagctaaatttactgccaatacaactgacaaactgcactcttaaaagaaacacttgaaacagcttcagtaatggaactatacagcttactgatgtagcttgagatagataccaactagatggccattttccaaagatggctaagaggatgctaaaggaaatggttatttagcagatatgaactggaacatgggagaggctagtggtttcatgttttcataatggccttcagtaagggcttcctcaaaggccctttcacaaggcttgacctgaattgggtttgatgtccttgcatatccatgatggcagtgttggttcctatttactccacaacggcaatgcttctaactttcttggccgttttaaacaaaatctacaggctttgactaaaattccaaaatcacctcaactaaaactgaaatagaatccgaaataatatttgttttataaatatatttcctcattgttactatttgcattatccttaccttctaaattttacatgtaaaacagctgtgtattttcaaaattaataatatttttgtttttaataaaaatgttattgagaaataaattaagataaaaatactggcacaatgcctatgcatttcagtatatttatacttcctcccagaaaagttcaatggtctcagaattttttgtattcttatttattttttaattggcaaatagaaattttatatacttatggtgtacaacatgatgttttgaaatacgtatacactgtagaatggctaaattaaactaccatttgactacctcacaagtttattagtggtgagaacatgtaaaatctattcccttagcaatgtacaatattgtacattgttgtcaactatggtcaccatgttgtaaaagaaatctcttcaatttattcttctaacagaaattttgtatcttttgacaaatatctccccaatccttcccttcctacccagccccatgtaaccatttttttacgctctactttcatgagttcagctgttttagattccatatatattagctttattagatcactattagaacatgcagtttttttctctgtgcctgatgcattttagttaacataatgtcctccagatttgagacaaatgaacgtatttgagacaaaatagaatactaaagtctaggttcattcacattgtcccaaataaaagaattcccttcatttttaaggctgagtaatatttcattgtatatatatatatatatatatatatatatatatatatatatatatcacattttctttatccattcattcactgatagatattttgtttgactccatatcctattataaataatgctgcaataatcatgggagtgcagatatctcttccaccaatagcctgatttaaaaatggaccaaggagcagaatagatagttccaaaagaagacatacaaatgaccagtaaatatgtgaaaaaaatgttcaatatgagtaatgatcagaaaaataaaagttaaatctacaatgagatatcacctcacatctattagagtaactattaataaatccacttcatataacttgtgtgtgaatatgtctctcaccaggttcaggcactggtaatactgcagcccagaatgcagtggagggaagcatttgagttcctattccggctggttcacatagtgacactgtgtgctatcttccacacggtgagagttttcccttaggatcagttattagtgaacttccttcacactgacctaaaatgtttctgtttttcgtctactcatctcacttttcacctgaacccctggtaaccaatgatctttttactgcctctatatgtttaacttttctagaatgtcacatggatgaaatcatacagtatgtagtttttttggactggcctctttccttatcaatatgtgcttaagtttcctctatgtctttttgtattgtgatatctcatttcactttattgctgaataatattacaatgtattggatgtatcacaaataactgcacttttgtaagaagaaaactgatcaaaataactccaaaatggtttaaagtaaatatttgcagattaaatgcaaaccgaaaaagttaactgctttggaattcgcatgcacaatacttacaatataacctcatgaagatataaactaattcatacatatcctttttgttttgtttagacggagtctcgctctatcgcccagactggagtgcagtggcgcgatctcggctcactgcaacctgtggctcccacgttcaagcaattctctgcctcagcctcctgagtagctgggattacaggcgcccaccaccacacctggctaattttttgtatttttagtagagatgaggtttcaccaccttggccaggctggtcttgaactcctgacctcatgatccacccatctcggcctctcaaagtgcaggattacaggtgtgaaccaccgcacctggcccatatatatccttttaatatttctaagtgttttttgaaaatatagattacaataaatctttcaactgagtatatattaactaattttctgaataatgactatagtagaataacataatttgcaatgtctaaatgttagacccagtttttaccgtataaatatagatgaaacaattacaatttaaaatctacttttattgttgagttcaagaagtaacaataaaagtaaatgttgtatgtgtcaaataaagcttctaattattttaaaagccaggcaatttaggatataaaagtgtttgtaaatagatgctataaaatttcactaggattcaatctggctctattgctttctttgtactaagagacaaatctaatttattttgacatgtttgagttcaatatatttgcaaatcagtaccaattaagatactgtttttctacctactatgagaggatttaataaaaatgggaagggaagaataaaaaaaaaacacccactagaactccgattatttataatcttggagtaattgcatcagagtgatctaattttacatatttaaataagaaaaacagtttaaaaaagacatgaatcaggagagagatgctagttcttccagaatacttaggatggattttagataagaaaattaatgaagggccaaaagactagacactgctttttacgtatgttccaaagaatgcgtgctttctgtcactaagagttttgcttctattcagttccttaaagaatcttcatctggaggatacaaaaactgaagtataaacaatttatccaaatatttgaaagcaaaaactgcaatctaaggtgtttggtttttcctttgcttaaattattatattgttctcattaaaatagtgtgttctaatctctcatagtcattggctcttaaagcttaaatccataagaatgcgctggagaaattttttaaacttactaaagtacagaagatccctgatttatgatggtttgactttcggttttttactttactatgggtatgaaagtaatatacattcagtatgctcctggacttacaacggggttaggtcctgataaacccatccctgtttgtctactgccctaccttaattattatagagggcccttctcactctcaaaagtgccctgctttggacaataaattatatggtcttacctatgctggaaactatatggatatattaaagtagcaaatttattcctctcgcttgaaaatttacaatttttttttagtgagaccgagtgtacaggtaatcagaattctgttttgaattatacattatttgacattaatatagtaatttctgctttcccttgtttgtaattgccagatatacattttctgttcactctatttttgtgcatgtgattttggtttaagtacattacttaatggcataaaatcatgtgtgaaaagtttaccagaggtaaaaagcattcttagaagattaagtaaatggcacagctattaagcaccggaggagttgggaaatgaatgacttatccattataaattggtgataaaaatgtgatgattttgaatcaagatttaaatagtataaaattctactttccatggagattgtggaagcacaaagtgacttccattaagaggatatgcatatgtcatttgcctgtttaacaccattcaatgtcttcaaatttctctgtgataatgaacaaagtttttagtatgactcagtaagtcccttcacagtccaactctccctacttctccagactcatcaccataggactccatttagtatgctattttgtctcaaatatgtttgcattgattactaataaaataaaattaatgtatcctactgtatgttttacttggatcaaaatttcccatagatacaatacaatgaaataatgggacgtataaaatcactctttgtattgaaaagtttgtgctaaattctaaacagtggatgtaagttgaactgtttggacttgagtcctttgttgaaggaagacttgcttcactctgctacatgagcaaatgccaaaatgtgtataaccttggaaatgtgaaagagaaattaaattccatgtaggtgcacagggaacctatcaaaactgtaatgaaagattgtcagaatcattttgtcaatagttaaatgggcgaaacctattatgtttgaggcaaggttttaatagtgccataaaaagacaggaaaggctatcttcaggtaaagccagctcttacattggacaacaaatctaaattaaaatagaaaacaattttagcaatcgagttatgctctctgcatatgcatttgttttacattattttaatagtcttcagacagctttcattaacttatttgcaatcaagacaaatcattctttccaaactattgttcatcttattaaaatcttttctcaaaatctgtaagtccaaacttggaaggttttataagaatgatagcctgggcaatatagcaagacactgtcactacaaaataattaaaaaaaaaattagctgggcatggtggcatgcacctaaagtcgcagctacttaggaggctgagggctgagatggaagattgcttgcagtgagctatgaccgagccattgcaccacagcctggaagacagaatgagatcttgtctctaaaaagaaaaaaaaaatgatggctatgttcctcaacataaggtaattttaattctctttaataatgaaatgttaactagacctgctcacttgctatttctttggccactgtgataatattacttgcattttcatagtttacaaaaatgaatgccttgattataaattatactttttctgttttgtatatcaagaggtataatgctaatcctttgttaaatatactctaattttattctttaatataaagcttcttgagaaacttattttaagtataaattgtgtaaaactttcaacctgtcatttattacaaaactaattcgtatgaatcaaccaactagcaattttttattttaacagagaaagtggtaagattatcttttgaagaagagttaaagtttttcaaaatttcagaatgttcacatgtataatattctgattttgaatttgatatattaaattttaataataatagaaattgaaaaggacttatagtatattctctgagtttagcaatatatcaacttaagaggttaacaaatataacttagggatatttgcccttattttattatatatataccagtataaattttgaatttaggttgttatggaaattacacttgcaaatatacaaatcttaaaaattaacatgaatgtgacactaaatcatgcaatggttaatattcaagttgatacatttccatttttaaataaaaaacaaaggcctacctatataggtggcatatatctttgaaaattttgcaattaattgtatttggcaaattttttgataaattgtgtaatataatgcatttcccactcaaaatcaatattcacatttagactctatgatctattccagacgtgttgaccttttcatgatatttacttttaaaactgatgacaagtgaatttcagtgtgtataagtcttagtccatcatcctgaaatgaaggtcaaatgtcattctcattcttcagaaggctaacttacttcacctatgggagtcaatgtaatctcaagtagtatgtgtttgaactactattaggattttgctatttctgtagggtttaaatgaaagatatataaaaggaatttaatgactctgacattgtaactaatttctaaaatatataaagagataattgaccgaaaatctcttagtaaatatgaacatgcagtgacaatgagagtatgcctctcagatcttcaactacaggaagcacaattggtcaaggtcccagttactgtggactgaaatctgtttatgtttgtatgaaggacatagttcctaagggctgcttaaggagtcaagtattgaaatgattattaggccaactaaatgatctctatagtctatttcattcattgcataatgtgaatttgagaaaagaatttttatgaataagattaacacatttttctcaatttctaatgaaaaacaaattgtagaaaatgatttaaacaaagatatgcaattgtaaatagatatgaagaaactacctaatcacttgaatggttaaaaaatcaaagtttataattggaatatttctgtgtaatagggatattacccggacttaattcatttccctcccacccccaccaaaaaatgaagctagttggagataattttgagaaagagaggtggaggatgtttcaacaataaagaatgaagaaatgccattagctttttaagaactctttgtttagctctttgttcaaggaaagatagtagagcaagaaggaagaatgatcacatggggcatgcaaattctaagacactaatatcattgttatatctttgtcaaaaatagaaactgaaggaaccaaataaaagagaaacaatgcatgtggaagatttgttacaatttgagatttttggtcgtgtgtatgcttctaaaatatacaaacgtttgtttacagttgtagaaaatgtcacaggatccttgggatgttgcttttccagtaggaagcctctgtggctggtggcacctttacatgaatttttttcaggcctactgggcttgtttcacccactcagcctggcaggcttcacttggcttcttctaccggcccagatcccatgcctgccaagggtgagccaggtgcagagcagcaaggtggggatgagagtgagtgtggggtccaccactgtgcacagccaggcacgctggctgctgtggtgggaagggtggccccaggtgccagcacagatgccagctccatacaagccagtggctggatctggtgcactgcaagcagattccactgaaggcacccatgtctggatgaggagaacgtggtggcacccagtagattggagacaacagaaaccagagtcccaaagacggtgtcatagccctggctcagggagctcctaggtctgggatccctgaagggccacttcgcttctcttctctccttctcattgcccacaatgtggcaagcggggaggcatgtttcagccctgctggtattactgctctttcagtcctgccattcagcaggtcccaagttcttgtcccacatctaggaagaattaggtatatagccatctgaagggtgagcaaggcaaagaggtgcttcattgagcaacagtacatctctcaggagacctgaaataggcagctcctatatgcaggcaggctgtcccgatgtctgcagccctcagtggcgaggagacccagagtgggtagctcctatcctcaagcaggttgtcctgatgtctgcctgagtctggttgagactggggtttttatgggcttcagaagggagaaagtgatattgctgattggtccatgggcagccatgggcagccataggcagcctggagaaagcaccataagttctcactccagtccagggaactggcaggctgggcaccagccttcaggcaatccttggctagaaggtggggtttcaccagacccatccctttccacccaggagcctgtctgccttctgctgccattcatggcacccaggctgtttgtgcccaagaggttcctgcaggcccgctccaggccacccccagccccaccttggcttctctcccatgctcattggtgcccaaagtccagagtgggctgaggtggcaaggggctggtatgtcagcaccacatgagtgtgggaacacacagccaggtggtgacaatgctcggggcttgatgacagctttgctctgaaattggagcaggccctggaagcagggagaggccaggcattgggagaacacactttgagcatgcagcaggaggggggcccaggtccacagtctcagctgggtgattgcacctgcacctgagagctctgggctccagcccctccaactcagaagtgggtggggcccctgcctgttctcagctctcactgactctgcagagtgcatagccccagctgtgtttccctggttgcagccagcgtctttgcagcaaatgctccagacaggtcgctgttgtcatcaaaaggaatagtatacagtatgaagagatatatatttcaaaagttttaagaagaactcattgttttctggatagaacaattgatcattaatgacaaatgaagcacacaatgtcttgatcctccatttcacctaagtgactccataaaagattgatgtgaaaaggtcaagaaattaacaaaatgagtctgtttcaattactataacagccctacaaagcaaagagaatcaagtgtatagtaattcttatctactataactctggccattataaaagtaaacatatgaggcaattttcttgccattatgtgattactcctacccttaatgattattgaaagccagccaccaggaaataacatcagttcacaggatttgaaaaaaaaaatcaaatcttttcccaatacatataaaatatcttaatattataaattataaaccagaaaaacatcattttccttgagaaatgtgtttttaaataatgacaacctaatttattttattgagtatagggttgtctttgtaaaattcttcaataattttcaaacttcattaagggagcattagcagaaagtaaagaagtaatttttttgttctgttttgttttgttttgttttgttctgagacgaagtcttgctctgtcacccaggctggagtgcagtggcgcaatctcagctcactgcaagctcagcctcttgggttcatgccattcttctgcctcagcctcatgagtagctgggactatgggcacccgccaccatgcctggctaatttttttgtatttttagtagagacagggtttcaccgtgttagccaggatggtctcaatctcctgacctcgtgatccgcccatctaggcctcccaaagtgctgggattacaggtgtgagcaactgcgcccggctgtaaagaagtttttaaatatgcaaatgaaacagaggcagagcatgattaactatgtggaagaaggggctggttttttattatgttgttacttttacataagtcagaaagcctactaattatctgtcatcaaaacttcacaggcaaaccagtaggtttttcctttagtaaatattaaagtacttactgtggtgtttattacttgtgtctattattttgctattttacaattttggaagaagacaatgataggtctattgttatattccagcaactaatcaattaccaatagaacaacatagaagtgctttcaattctaaaaaaagaacaatggattttgtttctctgtctagctagaactggtatactgaaaaacgtatgccaaatagtaaatgcgaactctgaaccatttttgatcaaggtcttcacaatgctagttttcagctcataactcaaatttacactttgccattatgctttcatttttattttctttatattttacttctgtgaccaagacactgcaacttctcagaaaactggagaaagtaattcattgtataaaatattcaacctttagcttgaagtccagaaaggtttggcttggaatatgtaatgttaatactcattaaactgaaatcactaaaaatacagatttttaaaacaaccagaaatgttaatctgagatttgctttgaattaagaaaataaatattcattctcttgatattttaagaacaatttacttcactaacgcatatttaaatgtaaaaatgtttctattctatcattagctcatgtaccccatggtgcattctaactaatcagtcattttaaaatcactgtggcaattaaaatctatgaatctgtaaattgtttacaatcacatgtttaatgtgctaggtcttcacctacaccatttcccctttttcctcaacaactgaggttgaactaggacacagttgcctagcaaggaacagcattcctctcccctagttagagctaaatgtagacccgtacctggattctcacaacgtaatgtgagctgaactgaaatgtgcaattctcacctcacttggttaaggaaatctctagatgtggacttctgtctggtttcccctttctgctgactaaaatggtaataatgagttattttgaaatagagtgttgaagatggtgacccctgagttgtcccaggtccctgaactttaaaccattgatatttggtggtttcctattacagtgacctaaactaccctaactcagtctgattaccctgagatttaatgatttaatgactgtctaatagaaataagtcaacggagtcagtgacagaacggggacgtatgggtcaataattcagttaaacattctacgataaataaatactttatctttaaaatctctcttttatacctaatcatttgttaaatgctaatttttcctatggaattcaaacacaagtattggaacgaagacattcctgagatgtaaaagccatgtgtacctcagcttacagtgctagattactgctttccatttgtaacacattaccttcccctacaccctacaaagaacataaatcttgagctatcatttttatatttcccccaaatttgatcacaagaagtagaagttttttcactaggagcaatcccaacacgaaagaccatcctaataatcaaaaattaataatgtcatttagcatctctgggaataatgtgcatccagttgaggcagtaaaatgaatttgaaaaaattagagaagaatgaggcatatgaggttggcagaaaccattctgtgcttcactttttttcattaagaaaggaaagtgtgttggcctctaaagcagcctgaaatggcataggcatattgccaaagctagcaattgaacatattaaaagaaaataccatacagaaataaaaatattctaccatgaatattttcatatttccatatattcatattttgcaatatgaatgagaatgacttttaaatatgattaattaattatgcgattagttgttggaaactaataaaatgttgaacaacttatattagttgaaacaacagtagctaataggactaagcctgctcaggaaatgatgcagaccacttagttccatatttttttggccagaaatcagtcaaacggcagaattcagaattcatccctagttaataaggagaggaaatgtaatccagctatatgcccgtgagaaaaaggatttaggaggcatccagatactgctatgtatttcctcaatggtcttcaaaaagaatgaagagataattgaagatgataatcattagccttaagtttctttatagttcagttaaaattttggttcaaatttagacctatataaacatttatattcaattatttgcatttatccaaaaagtagtgtccttgttcatatttggcataacatttatttttcaaattttctggttatttgataaaaaattaatccttttaagtactcaagtactactaaatgcattatgatcaagatactgattcttagcatctctgggagttatgtgtgtacagttgtgtatattattaatacacagtaggatgcaacaagattaccaaattctctttataactcagaataacaaatgaactgggataatcaagggcaattttgtaattgttagaattctggaagatcaaaattctcccacatgtacccatgtgactgttgttaattttagtaccatataattggctaacttttgctctctaagttaacaacaactttattaagagaatctatttgtagttaatagttctatgcagagacggtatgaaatggtaaattatacgttgaacaacacattcgcatttttaaaacatggcattaagcaaagatacttaataaagaaagttaaatgagcaatgccctgtttcaatttatgaccttggcctcaatgccacaatattttagctaaaagagaagtctagaggcatatttctattgacaaggaaatgagctctaaatgaaaacctagagaaacagtacaccacttaagtttatttaaagaggaagtttaagcaatatatcactttcttctcttggagtttccaaagataattagacttgccgcaaggggctttgaagaacacagatgggaattttaagttaaaactgtgagcgtttttttggatccacttagaagactaagtatattttttgagaacacctgatctagataatttagtgagaaacaaagtgagtttatatccgtcctgttcttgagaactccaaaattaacatgttcagagaagttcttccaaaacagaaaactgtgcataggagtccccctttatttatgggggatatactccaagacctccactagaagcctggaacttcagatgacaccaaagcctatatttactatgtttttttttttttcctgataacccagacagttactaagtgactgatgggcagcctggatacaatggacaaaggaatgattcagctccagggcagagtgacacaggacagcacaagatttcatcatgatactcagaatgccatacaatttaaaacttacgaattgtttatttctggaattttccacttaatattttctgaccacggttgacctcgggcaacaaactgtgaaaaatgatactgtggataaggaggggactactgtattccatagcaaagaattggaatccaatccaaaggattggaagcacaggttactgtgtcagaaaaaaaaggaaaataatagataataatgtacatgtgggtgagaataaccttttaaaacagattaaacaagaattcttatttgttttacatatggtttacatctcgatgatttacatacatgctatggaagattttctggtaattatattacataatttaattttgtgtagattcttctaaacgcagctttgtatgagaggatgaaactgcttggttcagtgggttaagtgcttgcagatgtatccctcacctaccttattcctcagtaccttagctgctgttctagcttaaaattattaattcattctaagaaagtaaaaaacactaaagtcatcctagaacatgatcaagttctccattacctgaaatattcatttttcattatcctcaattattatcatcatccaactttcaatttttctttggatagactaaactactaaaatattctggaatttaatgtagactcccacaccccttatttatatttctgcataggctgaatatttggtgtggaatatccatctatatctttttggattgactaaactctacatttccttcaatctacaacttaaaactgtgttaatcatgttcaaatatagttaagtgtcccttagcctgcttcctcaatactgtgatcttatttctaccattgtgttctcacagtgtattatatttttcatatagttatttgtttccagagataccagagagcttgctttctctctctctctccagataaggacatggcaaaaaggcagctgcctattaagaccagaagagaccctgaacctgaccatgcagacaccctggtcttaaacttggattgtcagctaccagaacaataagaaaataactttctgttgtggccgggcacagtgcctcacgcctgtaatcccagcactttgggaggctgaggcaggtggatcaggaggtcagagatcgagaccatcctggctaatgcagtgaaaccccacctctactgaaaatacaaaaaattagccaggcatggtggtgggcacctgtagtcccagctactcgggaggctgaggcaggagaatggtgcaaacccaggaggtggagcttgtagtgacccgagattacgtcactgcactccagcctgggcaacagagcaagactccatctcaaaaaaaaaaaaaaaaaaaaaaaaaagaacagaattttctgtcgtttaagccacccaatttatggtattttgttatggctgcctcagttgactaaaacagtatatatactaaccataaactataatatataatattggtgtatatgcatatagtgtatatatataaatgtatatgtattatatatgtgtatatatagtgtgtatatatatatacacacagtatatatataaatttatgtatacacacagtatatataaatacacacactacatttatatatatatatacacactatatatatacacatgcactacatatttacacacacaaacgtacacacatacacacatacacactgattagatggaaaatatgattgcagattgcatgccaaaattggaaattgaatgaaatgttccacctggcaataatgagaaactaaagatctatttctcaccattcagatcattaattagaattgaaaccccaaaatataatgttgtattttaataagtttgcactaattttttaaaaagtatccattattcattaaaccattactaaaacatattttatactaaattgtcatattaaccatttaaaaatttaaactatattttatgttaatttagaaacgcctaaaccaaaattggaagtctactcataaattcatattacatcaattttgagagactcctttcaaaaatgccctaaacatttcgtgtatttcaaaatcggacagaaatcaatacctatattcctcctgtgtgaagcgtgggatctcaccaggatgtaagacaagaatcttcactgtggcactgctggacatcacaggctccccatcatcaaaagcaaccaccaccaacttaaaaagcaataaaaattcatgttaaagattataagtaagaacagcgtaacagcacaatttttatatgtatgtttttacttattggattgcctggttccagaaggggaagcaatgatcatttcctcactgcctaccaggtggcagacactatgctagaaaatactacgttctcacttaatctttacaataatccagccagataaatgttattattttcacttgctagatgagaatactcaaagaagtaactaactctatgattaaaaaacaactaccagtaaaacaagtgtattatactatatctctccaattaaagactcatttctataattccactgaagcccacagtaaatacacatgattttatagcaccaatacacttatttaagaagtgttaaattcagacacataaaaagctaattatcttgctcaaaaaagaaattaattttcctagtgaattagttgtttttgagattatagggcagaaatactttactctagaggataaaattggaaatctttatagtttaacactctttggtatactatctcttaaaaacaaattataaggccaagttcatttggtatagcagaaattgttcaaatgatgaaaactaagaaaaagctttagtgttgagatgtgatgtctgacattatttatcactgcaataggatttataattgattattttctttaataacctacattacatcaaagtaattctatgtttactttaagacatgttaaatactttcagaactatgtgcttctttggaatataaattgttttggaagctgcaggttaacaatgtaaactaattcaacctagatcacagaagactgtaaccaaggatcatcctgagagccacaattgacctttgggttaatgctaatttacaaactgatcagctgttccaaacagcggtaaaatcatgagagacatagtgctcactgatccttacgtggttaactgataaagctatttccctactgtagagtcaaagactttattcacagtgacaaaaattattctaagtaactattaaaaatggaaatgttcaaacacttaataaaattgtctacttatggtaatgcaaattattgttttaataccttgccaggtagagacaggcattattttgtcaaatatatttttaaatatgtaaaaaacaaaagagggaatatgttctgtttcattagtatttgaagaaaagtaaaatttgacaaaaaatcaaatagatacagatattttcctagatatatgcaaagattaacataacaacaatcagtattgagtggtattaggaaaatggatactctcaggaaagatgaagaatgcatacaaggggtatttttttcaaattttctaggattgtaatatatcaatcttatcttaaaaaagtgagtaagggaaaaatgatattcatacaagtagttgcatgatagcatttattgtaacaaaaaatggaaagtctaattataaagcaactcagtattatattaaaaagaaaaacaaaatgttatatagtaaaatactatgaaaccactaaaataatagtattaatgtcacttattggcatagacaacatcatattgaatttaaaaaccagtatgtataagactatgtgatttgaaaacatatatttatatatttgtgtttgtatgaaatgtcatcatgaggatagagatcaaaacgcaaattctagctatttccaagatgtgagataccaagtggttttctttttactatttttgtaagtttctaagagaaaaaaaaattgtaatttaaaaaaattaaaaaggagaaaaattgaaagaaaaaaatgtgctgtcatctgttaagccaaattctctatcaaaaattaaacatcaaatagaccacataatgaaaagagacactgaccttaaaaattgttgtaggttcttcattaagattgactcgtgttattactcttccagaatcttcttccacttcaaaaatactggcagggtaaggaaactgtacatcatctactctatacctcacacgacttgcaggtaatccctaaaataaaattattaattattaatttgctgttaccaagttaaaacacagtgcaatgataatattaaatggatctttaaaattcatggtcttttagaagtgaaaatcatatttccatattttcattctttcagagctgaaatgtagccagatcattatttcttcatgataactcaatctgaatcaatgaagtatctctactacaggttattttaaaatgatttatatgagagaaaaattaatggttgctttgggcatcttctctaccactttcctttaattatgtgaattacatcttcctcccaaaacacccaatatctccttttttaaattcagagacagggtcttcctttgttgcccaggctggagtgcagtggcatcaccatagttccccataacctcaaaacttctggtttcaagtgttcctatcccactttagcctcccaagtagctgggaatacaggtgtgtgcaaccatgcttggctaatttgagaggactgtagtaaagtgcaggaatggacatgaaagctaaaaaaacaaaaattatttaccatctacactgtgttgattaccatgctaggtatttctatacatcattaggttaatgctcaatcttttaagatgacattaataatgaagatgatagtaataatggtaagttaatgacgctaacaattgctagatgcttaccacttgccggaaccacattaaagatgatgtatgtgtactctgttacccattttagagctaaggaacttgtggcttacaataagttaaagagtgctgaaatattccagagataggccaagataagttgggacaccaaacaaagtcacttttaaagaaaacaattaaaatttgataagtttttaaaagaatcaaagtgattgtaaaggaacagtcaaaattttgctggctgtcctcacttatattaggtttcagattggtttcctttggaactatgtagggtgacattgaggtgagcactgtaacatttacagtgcttaggccttgtaaatttcttaaaacctagaagtcaaataaatatcttgagcagagaactagtatgtggtaaagttttacttcaaacctaaacactaaattacaacattaacttcttcagagaaagaaacactcctatttggcattattctgatgaagaagaagtaagaacattaccccccacagggtgttgatttggctggacttgacactttggtgtaaaaactgttctgagaacattgctttttatatttccattttcttcaagactgtccttgaaaataatctgttgctcatgttggttcctgaattacagttgggctatgagataaatatgagttttcaggatttgtataattccctattttctgttagttcagtcctttcatatactacacgtcaccactgatgactgtctccttgaatacattctttatttaacctttttccactattctgccttttctccttcccatctggtgctctgtctcagactctgcttgttcccactctttctggctactaaatgttggagttttccaaggctctgtttcaagaacttctacattttctacttctactctcggcccctggaacctctcccagtctgatagcttcaaatatcttctatttgttcataaatatcaaattttaatatctggctaaactctgaacattttaagtccaaactagtacacataattgtccacagatatgctattttcaaataaatgtattcaaaaccagaatgatttcatctcccaaatttataactcttctactatagataatggctctaccttttactaaggtgttctatctgaaagcctaggggtaatcattgatcctttctcttaagccccatagccaaatcatcatcacatcctgccaatacctcaatgagtataggccctaatgtcttctcatatcctctgtgttttctgtagtagactcttaattgactttctgcttccattgtattaaaattatctcatgactcctgcttaaacccttccaatgattttgcatcacacacaaaaaaaataaatacaaagttgttagtaagggcaatctgatcctaaaaacatttcttttttgcctactcatctgatttcatcttgttcatttccctttcacacattttccttgttcctgcctccttggctttgccaaggcaatagtcctttaccaggaaaataaggtggcaatataatacactcatctctcagatttttggctaataaatttaccttcctcttctccaggcgttctctaatactccctttaaattatctttcttcagcaaccctgtctgaaattatagcatatattttatgtatttacttgtttactgtttgtctcccacataagaatacaagctttattagggtagggactgtagctgagtaccttgaatgttacctgacccataatatgtactcaaggagtatttgaataaataattttttatttataaaaaaatttatttataaattttatttattcataaaatttttataaattttatttattcataaaatttttataaaattttatttattcataaaatttttataaatttatttaaaaattatttataaaaattttatttataaattttatttataaaaaatttatttgcataaataagtgaatggataaccacacatcaagggtgcccagacacttcaactgatatctaaagtattcatatatttgaaggtttgggaaatagagaacattgaataaaccttgaaagcatgttagggaactgccagttctgggataatatttttatataaaccactgatttcacctagtggtggatggtcagttcacccactgaagatttatagaaacaaggacacatttttttagaaaaactttggcctatatggacagaatcagacttattataatcatatacaatggcaaaccttgtatatgatttgcttgtgaaagagtgggggtttagcagaagacatcgtaggacttggggcacagtgtcatgcaatgtcagcaactttgcttgcatttgaataataatgataataacaagagttgttagctatcagtttgagtattttactatgtatcagactgcatgtattacatgcattttcatacctacaataagttcagaagttggtattaatagtacctacatttttttttttttttgagacagagtcttgtactcttacccgggctggagtgcagttgcacgatctccgctcactgcaacctccgcctctcaggttcaagtgattctcctgcctcagcctctcaggcagctgggactacacgagcccgccaccatgcccggctaatttttttctatttttagtagagatagggtttcactatgttggccagccaggtcttaaactcctgacctcatgatccgctcgcctttgccttccaaagggctgagattacaggcgtaagccaccgcgcccagccctactacctatatttttaaaataataaaatctaggctttaagaattatcttctgaaattttcttagctggaaaatgccaaagttattaattgaacaaacttggctcacactaaaaccgaagtcttttaataacaaatcaacttaacatttttcagtactatcttaaaggcaatagtcctttaccaggaaaataaggtggcaatacaattgagcaaaagtgcttggcaaagatactatagaatttgataccctagtaaatctcgccttagaacactttctaagaggttatgcagcacataattcaagtcacctccagaacaggaggtcaatgatgaaagaggataattatagcaccaactgcttcaagaacaaatttttagagtttttgctagcatgaggacccattcagtctgtaggacggtgactaaaattacttatgacaatcagattggctctcaaaaacataaaataagttaattatacttagaatcttctttttaataaagccaaaatttttttttgcatatggaattatgcctgtaattgataaaatgaaaaagaaaacatgctggtattatggaatgttatctctcagatgcctaaaatagtttgctatccagaacatcttagaacttcctggatgatttttacagataagattgtatgtatataaatatgaacatatgactaaaatagtttgctatccagaaaatcttagaacttcctagatgatttttacagataagattgtatgtatacaaatatgaacatacatgttacatagtgactacatcaataaactttttattctaagattgcaattattctatagatataccacaccatcatgaaagtgtggccctgagaggactcatttagcctgcaagaaacattttgattcttttatcacccttgttatcaaagcacattttattttatatcacatattatgataactatactaaataactaaaatgatgtagactttcctctcaaaacatttaaaagtttttttctctctctgtcctttcctaaaatcttccttcccttcttcccttctttttgctttcccttcctccctcctttcctttctttacttctttccaaagtctttttaaaatagttgcataaataagctatataataggtaaaggtaataggctttgggaaacagctctaattcctaatattatttctgggaaatttacaaaatgaatcaagtcaaattcattgttttaagaaattataaaaatagctgtggctttaatcttggaaaaaattgtcattttgaaacccagaatttcaagtactctaaaaaagttataaacttgatcacttaaaattatgaattagcatttattaagtatcttttaatactttattccactaaaatataatagatatgatcgaagtattctaatgtataaaactcacccttattagttatgttttaaaaactaaaataatatagtaaatgagtttatgaattatatattttaattattatatatgtgacaattaaatatttaaataatcattcatatatatatgtatatatattttaaagacaggatcttgtgttgtcacccaggctgatgtgcagtggcatgattatagctcactgcagctcacacaatctttctgcctcagcctcccaagaggcttgatatggtttggctttgtctccacccaaatttcatcttgaattgcagttctcataatccccacatgctgttggagggacctggtgggaggtaacttaaacatgggggcagttaccctcatgctgttcttgggacaatgagtggcttctcacgaaatctgatggttttataaagggcttttcccccttttgcttggcactcctccttgctgctgccatgtgaagaaggatgtgtttgcttccgcttccaccatgactgtaagtttcctgaagtctccccatccctctggaactgtgagtcaactaaaactctttcctttattaactacccagtcttggacagttctttatagccatgtgagaatggattaatacatagctggaactacaggtgcatgccatcatgctgaactaattatttttaattatttgtagagataaggatttctttatgttgcccaggttggtccagaactcctggcctcaagtgttcctttcagtttggcctcccaaagtattaggattacaggtgtaaaccactgcacctggcctagacaaacattaaatttccaaatatttgcttttattttaaattgtattaggaatagacagaagtctcttttatatatacccaataagttaatgtttctttcaattaaatacttcaaataatcatattttttaaagtaaactatagaaaacatttaaaatcaatatgaaaattttaaatattaatttctacttcattcatgataatatagtatgtatattctaccgtatctctctatgcatagctgtatatatgtcaagaggaattttttggaccatgaataatgataaaagctatctatttacaagtaaatcaatatttggaggaggttccaagatggccaaataggaacagctccagtctacagctcccagcgtgagtgatgcagaagacaggtgatttctgcatttccaactgaggtaccgggttcatctcactggggcttgttggacagtgggtgcagcccatggagcagggtggggcattgcctcacctgggaagcacaaggggttgtggaatttcctttcctagacaagggaagccatgacagatggtacctggaaaattggtacactcccactctaatactgcgcttttccaacagtcttagcaaacggcccaccaggagattatatcccacgcctggctcagagggtcccacacccatgaagcctcactcactgctagcatagcagtctgagatcgaactgcaaggcagcagtgaggctaggggaggggcatccaccattgctgaggcttgagtaggtaaacaaagtggacaggaagctcgaaccgggtggagcccaccacagctcaaggaggcctgcctgcctctgtagactccacctctgggggcagggcagagctgaacaaaaggcagcagaaacttctgcagacttcaatatccctgtctgacagctttgaagagagtagtgcttcccccagcacagagtttgagatctaagaacggacagactgcctcctcaagtgggtccctgacccccaagtagcctaactgggagacacatcccagtagaggccgactgacacctcatatagccggacgccactctgagacgaagcttccagaggaaggatcaggcagcaacatttgccattctgcaatgtttgctgttctgcagcctccgctagtgatacccaggcaaacacggtctggagtggacctccagcaactccaacagtccagcagctgacggtcctgactgttagaacgaaaactaacaaacagaaaggatatccacaccaaaaccccatctgtacatcaccatcatcaaagaccaaaggtagataaaaccacaaagatggggagaaaccagagcagaaaagttgaaattctaaaaatcagagcacctcttctcctccaaaggaacacagctcctcactagcaatggaacaaagctggatggagaatgactttgaggagttgagagaagaaggcttcagaccatcagtaataacaaacttctccgagctaaaggaggatgtttgaacccaccacaaagaagctaaaaaccttgaaaaaagattagacaaatggctaactagaataaacagtgtagagaagaccttaaatgacctgatggagctgaaaaccatggcacgagaactatctgaggcatgcacaagcttcagtagccgatttgatcaagtggaagaaagggtatcagtgattgaagatcaaatgaatgaaatgaagtaagaagagaagtttagagaaaaaagaataaaaagaaatgaacaaagcctccaagaaatatggaactatgtgaaaagaccaaatctacatctgattagtgtacctgaaagtgacagtgagaatggaaccaagttggaaaacactctgcaggatattatccaggagaacttccccaacctaacaaggcaggccaacattcaaattcaggaaatacagagaacgccacaaagatactcctcaagaagagcaactccaaggcacatgattgtcagattcaccaaagttgaaatgaaggaaaaaatattaagggcagccagagagaaaggtctggttacccacaaagggaagcccatcagactaaaagtggatctctaagcaaaaaatgtacaagtcagaagagagcaggggacaatattcaacattcttaaagaaaagaattttcaacccagaatttcatatccagccaaactaagcttcataagtgaaggagaaataaaatcctttacagacaaacaaatgctgagatattttgtcaccaccaggcatgccttacaagagctcctaaaaggaagcactaaacatggaaaggaacaaccagtaccagccactgcaaaaacatgccaaattgtaaagaccattgatgctaggaagaaactgcatcaactaacgagcaaaataaccagctaagatcataatgacaggatcaaattcacacgtaacaatattaaccttaaatgtaaatgggctgaatgctccaattaaaagacacagactggcaaactggataaagagtcaagacccatcagtgtgctgtattcaagagacctatcttatgtgcagcgatacacataggctcaaaataaagggatgaagatctaccaagcaaatggaaagcaaaaaaaaaatagcaggggttgcaatcctagtctctgataaaacagactttaaaccaacaaagatcagaagagacaaagaaggccattacataatggtaaagggatcaattcaacaagaagagctaactatcctaaatatatatgcacccaatacaggagcacccagattcataaagcaagtccttggagacctacaaagagacttagacttccacacaataataatgggggactttaacaccttcaggtcttcagagcagaactgaaggagacagagaaacaaaaaactcttccaaaaaatcaatgaatccaggagctgtttttttttaaaaaatcaactaaattgatagactgctagcaaggctaataaagaagaaaagagagaagaatcaaatagacacaataaaaaatgataaaggggatattaccactgagcccacagaaatacaaactaccatcagagaatactataaacacctctatgcaaataagctagaaagtctagaagaaatggatgaattcctggacacatacaccctcccaagaataaactaggaagaagttgaatccctgaatagaccaataacaggctctgaaattgaggcaataattaatagcctaccaaccaaaaaaagtccaggaccagatggattcacagccaaattctaccagaggtacaaagtggatctggtactattccttctgaagctattccagtcaatagaaaaagaaggaatcctccctaactcattttatgaagtcagcatcatcctgatactaaagctggcagagacacaacaaaaaaagagaatttaaaccaatatccctgatgaacatcaatgtgaaaatcctaaacaaaatactggaaaaccaaatccagcagcacatcaagaagcttatccaccacaatcaagtgggcctcatccctgggatgcaaggctggttcaacatacgcaaatcaataaacgtaatgcagcatataaacagaaccaaagacaaaaaccacatgattatctcaatagatgcagaaaaggcatttgacaaaattcaacagcccttcctgctaaaaactctcaataaactaggtattgatgtaacctatcttaaaataataagagttatttgtgacaaacccacagccaatatcatactgaatgggcaaaaactggaagcattccctttgaaaactggtacaagacagggatgccctatctcaccactcttattcaacatagtgttggaatttctggctagggcaatcaggcaggagaaagaaataaatgatattcaattaggaaaagaagaagtcaaattgtcccttttttcagatgacatgattgtatatttagacaaccccatcatctcagcccaaaacctccttaagctgataagcaacttcagcaaagtctcaggatacaaaataaatgtgcaaaaatcacaagcattcctatacaccgataacagacaaacagagagctaaatcatgagtgaattcccattcacaattgcttcaaagagaataaaatacctgggaaccctacttacaagggatgtgaaggacctcttcaaggagaactacaaaccacggctcaaggaaataaaagaggacacaaacaaatggaagaacattccatgctcatggatacgaagaatcaataccatgaaaatggtcatactgcccaaggtaatttatagattcaatgccatccccatcaagctaccaatgactttcttcacagaattggaaaaaactactttaaatttcatatggaaccaaaaaagagcccacagccaagacaatcctaagccaaaagaacaaagctggaggtatcacgctacctgacttcaaactatactacaagtctacagtaaccaaaaacagcatgatactggtaccaaaacagagatataggccaatggaacagaacagagccctcagaaataataccacacatttacaaccatctgatctttgacgaatgtgaccaaaacaagaaaaagggaaagcattccctatttaataaatggtgctgggaaaactggctagccatatgtagaaagctgaaactggatcccttccttacaccttatacaaaaattaattcaagatggattaaagacttagatgttagacctaaaaccataaaaactctagaaaaaaacctaggtaataccattcaggacataggcatgtgcaaaggcttcatgactaaaacaccaaaagcaatggcaacaaaagccaaaattgacaaattggatctaattaaactaaagagcttctgcacagcaaaagaaactaccaccagaatgaacaggcaacctacagaatgggagaaaatttttacagtctacccatctgacaaaagggctaatatccagaatctacaaagaacttaaacagatttacaagaaaaaatcaaacaaccccatcaaaaagtgggcaaagcatatgaacagacacttttcaaaagaagacatttatgcagccaacagacacatgaaaaaaatgctcatcatcactggccatcagagaaatgcaaatcaaaaccacaatgagataccatctcacaccagttagaatggtgatcattaaaaagtcaggaaacaacaggttctggagaggatgtggagaaacaggaacacttttacactgttggtgggacagtaaactagttcaaccattgtggaagacagtgtggcgattcctcaaggatctagaactagaaataccatttgacccagccatcgcattactgggcatatatgcaaaggattataaatcatgctgctataaagacacatgcacacctatgtttattgtggtactattcacaatagcaaagactttgaacaaacccaaatgtccatcaatgatagaccggattaagaaaatgtggcacatatacaccatggaatactctgcagccataaaaaaggatgagctcatgtcctttgtagggacatggatgaagctggaaaccatcattctgagcaaagtattgcaaggacagataaccaaacaccacatgttttcactcataggtgggaactcaacaatgagaacacttggacacagggcgaggaacatcacacaccagggcctgtcatggggtggggggaggggggagggatagcattaggagatatacctaatgtaaatctcgagttaatgggtgcagcacaccaacgtggcacatgtatacatatgtaacaaacctgcacgttgtgcacatgtaccctagaacttaaagtatattaaaaaaataaattaaaaaaacaaatcaatatttaaaattgcgttactacggcgatatatttcttttctatatcattttgaaattgtgataaaattgctttaatatgaacactaaaagcagtatacagaattactttcttaaagttcttactgaccagtaaattacttttttggttccgtactctcatcaaccaaatatagtgttctctatttaggtttagaaaaatcttgaggtcattagttatttccctgtattcacacagtattaccactagaccacagcatttaaatagatttttaaaagatttttagaaaaaaaaatcatagccattgctccttcactgctgaagacagaatgagatttggtttcaacaaatacttagatatgaggaagagcctttctaattggtaaagtaacatagtctccttcagaaggatacatgtattttagaaataaaatattcaaaataggagcatgctattacaggaaggttactaaatcaaagtgagctgaaaacgttgccaacatagaataataactgaatttaatgacaattttatatttgtttatttgtttattttaccttatttttcttgagacagagtttcactctgtcgtccgggctggaaggcagtggcgtgatcttggctcactgcaacctccgcctcccaggctcaaatgattctcgttccttagcctaccaagtagctgcgattacagggacgctccatgcctggataatttttgcatttttagaagagacagggtttcaccatgttgcctaggctgctctcaaactcctgagctcaagtgatccacccaccttggcttcccagagtgttgggattacaggcatcaaccaccacatccagccagaaattaaacacaatttaaaacaaatctctaggggctttttgttttccattagataaaatatacttaactttaaagattagtatcatacaactaagtaataatatacttatttatataagatatatttgtaagagaaatttaaaaattgtctaaaatattagaaattaaaaattttataaactactaacctgtcatcatgctcatatgttttatttctatttatttgtgaaatacagcattttttcagtccttgtttatatgaaaactgtctaaaggtttgatagttaatcactctatctttcctggaacactctttatatgggttatagaatatcatattccacactactggctgccttagtgatcactcttcattcttctatttagctgattcgtttacctattcacaactttcaagtgatggcgaccacaggcgcctctgccctttttcttattttttttttaaatttcaacttttattttaggttttggggtacatgtgcaagtctgttacacgatgtttcataatgctgaggtttggggtacaattgatccagtcatcgaggtagtgagcatagtactcaatatgtagtttttcagctcttgctcccctccttcccccacctcctctaatagtctccagtatctattgttcccatctttttgtccaggtgtacccaatgtttagctcccacttataagtgaaaacatgcagtatttggttttctgttcctgcattaattcacttggtataattgtttccagctgcatcaatattgctgcaaagggcgtgctttcattcttttttatgtttgcatagtattccatggtgcatatgtaccacattttctttatccaatacaccactgatggacactcagattgattccatgtcttagctattgtgaaaagtgcagtgatgaacatataagtgcatgtgactttttggtagagcaatttatttttctttggttatatacccagtaatggaattgctaggtcaaatgatgattccattttaggttaattgagaaatctccaaactgctttccacagtggctgaattaatttacattcccaccaacaatgaataagtgttttttttccccccataacctcaccagcatctgttttttgactttttaataatcaatactctgactggtgtgcggtggtattttactgtggttttgatttgtgtttctctgattattagtgatgaacattttttcttatgtttgttagttgcttgtatgttttcttttgagaagtgtctgttcacgtcctctgatttttaatagggtgtttgttttttgcttgtcgaattaggttctttatagatgctggatattagacttttgtcagatgcatagttcataaacactttctcttattctataggttgtctgtttactttgttgatagtctcttcgctggggcaaagctctttagtttaattagttcccactcatcaatttttgtttttgttgtaattgcttttggtgactgagtcaaaacttacgtgccaagagcaatgtctagaatgatatttcttagatttccttctaggatttttatagttttatgtcttaaatataagtaatttattcatatcaaaaaaatttttgtatgtggttgaaggaaaggcctagtttcattcttctgcatatggctagcgagtatactagcaccattcactgaataggcaatttttctctatagtttgtttttgtaagttttgtcacatgtcagatggttgcaggtgtgtgactttatttctgagaactctattctgttccactggtctatgtgtttgtttttgtaccagtaccgtgttgttttgattactgcagtcttgtattaataatatagtttgatgtagggtagtgtgatgcttccacctttattctttttgctttgctcatatgagttatagtaccatgcttaaccctaggtaatgtggggttcattcattcattcattcatttaacacgttcactaaatagaaattactgagttgtgagagtataaaaaatgaaaaagctcacaaggagatggagttgatctcacacccccttctcctgaatgttctttagaaataattcatccatattgaccttatcaaacaccaacctccttcctacctcaagcttttccatttgcttttgtctttgcctgtaagactcttgcatcattatcctcttttaacattctggtctcaaatgacacaaactcctctgcatatactcatccacaaactactctatcactattatttttatagcacatatgcttatgtgaaattatgttacatatttacttgtgtatggttttgcagcctgtctctgtccatcatctgtaagctccattcgagtagattttttttgtgatttgccattatttaagagggcaataataatttgttaaatgaatactacaactgatttaaactgtcccatagaagtgatatttacggtgtcttttaaataaacatagaaattaaccttctcagtcttaaaacttgagagagctacatttgttttatctgagttattttctaaggacaccaaccatcgggcctcccagagagtatcaaggaactgaaacttactagagcactgcatctgggcaacgagatacaagacccttcactgtcatgactggctaactgagtccctgtttactgttaaccaactcatcttctttatctgtccctaattcctgttttcctgcatgtagttacatttcttctctgcaatataaacccctgattttagtcagtctgggagatgtatttgacactaacctcccatctcctgggctgcagcacctgattaaagccaaccctggcaatgctttttgtctcagtgatcggctttctgtgcagtgagcaacaggacctagaccaaggatgtccgatcttttagcttccttgggccacattggaagaagaattatcttgtgccacacatataatacactaacactaatgatagctgaaagctttaaaaaaaatcacaaataaacctcataatgttttaagacagtttatgaatttgtgttgggctgcactgaaagctctccttggctgcatgtggcctatgggccatgagttcgacaagcttgatcctagaccaaacccctgacatttcagtaacacttacgtgtatgtgtatcatgagctgccaagatgtataacacatggggattatgagaaaaacagttcaagataagatttgggtggggacacagccaaaccacatcattccaccctggcccctttcaaatctcatgacctcacatttcaaaacacaatcatgccttcccaacagtccctcaaagtcttaactcatttcagcattaatccaaacgtccaagtacaaaatctcatctgagacacagcaagtaccttctgcttatgagcctgtgaaatcaaaagcattgttacttcctagatacaatgggggtataggcattggtaaatacacccattccaaataagagaaattagctaaaatgaaggggctacaggccccatgcatgtctaaaatccaggggggaagttaaatcttaaagctcccaaatgatcttctttcactccatatcatatccaggtctcactgatgctagaagtgtgctgccatggccttggacagcactacccttatggctttgcagtgtatagccccctcttggctgctttcatggctggcattgaatgcctgtagcttttccaggcacacacagcaaactgtcagtggatttaccattctggggactggaggacagtggctctcttctcacagctccactaggcagtgcaccagtggggactctgtgtgggggctcccaccacacatttctcttctgtacttccctagcagaggttctccatgagaattctgcccctgcagcacacctctgcctggacatccaggcatttccatacatcctctgaaatctaggcagaggttcctaaacttcaattactgtcttctctacacccgctggaccaacaccacatggaagctgcctaggattgagaattgcatcttctgaagcgatggcctgaactgtaccttggcccattttaaccatggctggagtggctaggatgcagggaaccaagtcctgaggctatacacagcaggggggtccctggacccagcccaggaaaccatttttccctcttaggcctctgagtgtgtgatgggaggggatgctgtgaatgtctctgacatgcccagcagacatttcccccattgtcatggtgagtaacatttggctcctcattacttacgcaaatttctgctgccaactggaattcctctccagaaaatgtttttttttttttttttctactgcatcatcaggctgcaaatttttcaagcttttatactctgcttccttttgaacactttgctacttagaaatttcttccaccaggtaccctaagtcatctctctcaagttcaatgttccacagatatctagagcaggggcaaaatgctgcgtctctatgcatagcaagtgtgacctttactccagttcccaacaagttcctcatctccatctgagaccaactcagcctggactttattgtccatatcactttcagcagtttgttcaaagccattcaacaaatctctatgaagttccaaactttcccacatcttcttgtcttcttctgagccctccaaactgttccaacctctgcctgttacccagttccacagtcacttccacattttcagatgcctttacagcagtgccactctacctggtatcaaattactgtattaatccgttctcacactgctatggggacataccagatacttggtaatttataaagtaaataagtttaattaactcatagttctgcagggctggggaggcctcaggaaacttacaatcatggcagaaacatacaagacatccttcttcacagggtgacagcaaagagaagtgcagagtgaagtaagggaaaaatcccttataaaaccatcagattttgtgagaactcactcactatcatgagaagggcatggaagtaacctccccatgattcaattgtctcccactgggtctctcccactacacgtgaagattatgggaactacggttcaagatgagatttgggtgaggacacagcaaaaccatatcaccctctaagaatttatttatctaagaatggggatacattgttggcaagttttcaatctataacctataaatatctgctaattttcgcattgacagcttctcatattcgtctctcaagatggtggacaaggatgagaaacataggtatgcttttgtactcatgggcctcacaattggacaggttggagagacaaaatgtacacataaaaacacaattatttcccaacatttctgattaaaactgtgaaaaggaaacatgtggtgctattaaacggaggtgctacaactagagaacagatcttaagatttatagtaaactagactttaaaactcactgcagacactcacaaatcacaaaatacacaaaatgtattttagttcatagagcgtatagtaattgtgttatatgtacagtctaatttagtatatcatttgagtattaaaatgataaactaggccaggtgcggcggctcacgcctgtaatcccagcacttcgggaggccgaggtgtgtggatcacctgaggtcaagagttcgtgaccagcctggccaacatggtgaaactccgtctctactacaaatacaaaaaaattagtctggcatcgtggcgggcacctgtaatccaagctacttgggaggctgaggtaggagaattgctagaactctggggcaggaggttgcagtgagctgagatcacaccactacactccagcctgggtgacagagtgagactccatctcaaaaaaaaaaaagaaaaaaacttaattttattaggattttgaacaaggggtaaaagtagacatatatcagtaggaagttacataaattaaagctgtcttttaaacaaaaagtcttcctaatttttggtaagaacgttattaaaatatgtatattttaaaaatgtgtgggattctaaaggccctgtcagcatattttcacgaaaactttcttctcgaatattacagtgccatggatgacatcagagttacttcaagagtttaggtattaatatcctaaagtttacagttgatgaggatgtaagcactgtaccaaactagatgcaaagttgtgtttttccatcactctggaagtgaggagaaagaggaggaaaaattaactaacatcaatgtgcttcacatgagctaagtgtgtcattctccatcaagcccaaacaataatccagcaaaatagttcttcttattcctatatgattacaaggtttaaagaggttaattaactgctgtacaatataatttttatgagttaaacaaaaacaacaacactagtgacatcagtcaataattttcatatactctagagtgcccaaacctaacggcactcaggaagaacatgatttatgacatctattataaaggaatcaattttttttggttcatgatttaggtatctttctaaatatgattgggggtagtatgtaacttatttaaatattatgtggtttccaaaatatgtaacaaatgatatcagctttgtgatgtccttttatctgctaaatttgaaatgtgtaaaattcaataattatgagtatggatatttactcatatctgtattaacatgaataacacatggcagacaaatcctgcattggtgatgctcacattagatttttaaaataaaaatgtgatataattctacagagtaataaggcgagaataattaatatagcagaatgaatgtaaatttacaccaagaaaatagaataataagatttcaattattttcttcattattcagcacattttctacttttgatttctattcttacagtgtgtgttaaacacaatatgtttcgacttagttatcatgagaatataattaattactacagaaggtaattgcatacctgtatgaaggatgtttcaaacttgaaaacttagggaatttcagtgaggcatcacgctacctgacttcaaactatactacaaggctacagtaaccaaaacagcatggtactggtaccaaaacagagatatagatcaatggaacagaaaagagccttcagaaataacgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaaggcaaaattgacaaatgggatctaattaaactcaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaaggtggcaaaggatatgaacagacacttttcaaaagaagatatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttacactgttggtgggagtgtaaactagttcaaccactgtggaagtcagtgtggcgattcctcagggatctagaactagaaataccatttgacccagcaatctcattactgggtatatacccaaagaattataaatcattctgctataaagacacatgcacacgtatgtttattgcggcactattcacaatagcaaagacttggaaccaacccaaatgtccaacaatgatagactggattaagaaactgtggcacatatacagcatggaatactatgcagccataaaaaatgatgagttcatgtcctttgtagggacatggatgaagctggaaaccatcattttcagcaaactatcacaaggacaaaaaaccaaacaccgcatgttctcactcataggtgggaattgaacaatgagaacacatggacacaggaaggggaacatcacactctggggactgttgtggggtggggggaggggagagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaatataaaaaaagaaaatataatggactaaaataattaggtccttagtatcaggggaaatcttgatttagtcatttttcttaaacacataattatcaagaaattacttactcaggctcacattgtttccttcataatttcttcatagttatagcaatcacattgtagcagggaataccaaacttattattatcattaaaaacaaatattaagtaatttgttttcaagaacacaaatattttaccccgacatggtttccaaaattctttttcccaaagtctttgaggcaactactctgactgattttgtaacagtgcaattcacaaaatctcccaagtatgatttaacatcaggaattactataaaggaattactataaagtggtttgggtgtgtgtgtgtttgtgtgtgtgtgtgtgtgtatacatatacacacacaaaatatatatatacgttttgcaggcatgtgacttagtcatattttagtgaatttaactggatgtcaaggtatccttaaaggacaaaagagaaagaaaaaaaaaaaaacagcaggcggaactcttcatgtaaccactgagaaagtcctgtgctttttttacttcttcctccctcttccctgtttttaacacctggaatgaccaatatgttttgacaacatgttggcaagttccttatgcagtttgacacttaatataaggtgtttgtatagttcagtttctacagataggatattgacacagctatttaagattgtaaaaaatacttgctttagggctatttaccactaaatgttttgggaaatgtgcttttcaaaggtaaacgtaactcgacccttaaaggtatgaaataacacattccttgtaaaatttatttatttaaacacagttgttaagtttatgaagttgacatttggcacaccgtcagactttcctaatacaaaaaattcatgtagccaaaggaacttagagatgaaccttatctgagctagtaattagtgaccctatattctatgccttaaattcttaacactgtcttcacaatctacaagattaagcaggatccaacttaggtttccctctccatcctcctgaaaaaaaaatggccttggtttttgaaacttactgttcttcctcatacttcagggcctgattcttttgttacgtgactttatcttggcataaccttcagacctccgctcagaatcacttctagaaccttccttgactctctagatacaatcatgctccctcttatctggtttcatagaaccctaaacatttctaagtgcttttctttttttttttttcttttttcttttctttttttttttttttttttgaggcagagtcttgctctgtcctccatgcttgagtgcagtggtgcaatctctgctcactgcaagttccgcctcctgggttcacaccattctcctgcctcagcctcccaagtagctgggactacaggcgcccaccaccatgctcggctaattttttgtatattttagtagagacggagttttaccatgttagccaggatggtctcgatctcctgaccttgtgatctgcccacctcggcctcccaaattgctgggattacaggcgtgagccaccgtgcctggccttacttgattgactttttaacttttatcctttcaagtttgaaataccaaggcttggaaccatgacagttttcccttatgcttaatctagcatctcttatataatagaatctctttaaataatattcaatgcacaaacatatagtaaatcttgaggaatttttattgtgtttggatctcaagggcacagatttgagttaaatattacctatagtttatgaaacattatcattgatggatcttcaaggcatatttgtttattcatttctttctcttcttttattctcatacctgtttttcctatctctctttgccaccaatggcaatctttttaatacatttaaggagtatcttttaactagaccatttatggtacattgtattatagtttagcaaatatcccctcccctttcttctacttcctattctgattttttgggctaggccatgtgacttgctttggtcaacagacatgaagaactgtgacacgggagcagtctttacatgtcatcatgtggttaggcaagttctcttaggattctattctcactatgtgaaaagcaggcctggttagccatgcgtccctgcagaaggagatatgtggaacagacatgagcccagacaaggtcagccaactcctagctgcctcacagacccataaataaaaatattgatctttgctattgcagaacagtgagattttggtgttgtttactaagaattgtttttgtaggaaaaactgtagaagcttctgtgtgcttaaaaaaaaaactttatataatggtattgctttctttttctattttcattgagcactcagttcttacacttcattctttttgctatgtgttaatcaaatcctgctgcaccagaagttcacagggtacttcacactaactaatgatcacagttgtataggaatctctggtatatgttagaaagttcataatatgacatacaatgttcctgacagtggcattgtcttgaatgcttttaaattatttgactctgtagtaaagatggcttgaggttggagagaggatggggtggcaggctctccattaccatggtgagtggaacagccaggtgtgaagccaaacaagctgtagcatttagccacaatggtagtgtagtcaaagggaaacttcaaaacagaatacttgggtccagtccttagattataaacacaccccgagaaaagatcaagcagggaaaaaattgtcatggtcatgtttcagaggcatagcaccttcctgactccctactaccttatgctacccacttcttctctacaacttatgctcaggttcctggacctctgacctttacaggattttccagaatgcaggggaaaagcacaaagagaaggaagcagatcacaaaatataaatatggatgacagatctcatagacttaaaccataaaaaaggtcagagtaaacataaaaaaaagatagttaatatatattatttactatgtagtaggcaccaactgttccacataaatgacatcatttcaacatcacagcaaccctataaagtatttcttttgtttttagaacacatgaaatatattctttaaacaaatttttaagtgtatcacacagtattgttaactacagtcacaattttggaaagcagatccttagaacaataccagaaaaacaaacaacaaataactcaattaagaaatgggtaaaggatttgaataactttttcaaaaaaaaacaacaacatacacactcgacatacaaatggccaacagtacataaaaatgtgctcaacatcattagtcataatggaaataaagtcaaaactacaatcagatatcgcctcatgctttgtaggatggcttttatttaaaacaaatttttttaaagttagcaagaatgtgaagaaattgctacacttgtgcattgttggtggaaatgtaaaatggcactgtcaatatgagaaacagtatggggtttcctcaaaaaaattactaatgtaactaccatatgatccagtagttccacttttgggaatttattcaaaatatttgaaatcaggatctttaagagatatctatctgtactcccatgtgtactgaagcattattcagagtatccaagatgtggaaacagactaaatgttcattgatggatgagtggataaagaaaatgtggtatatgcatacaagtgaacattactcagctttaaaaagaaggaagtactgccatttgtaacaatgtgaacgaatcttgaggacattatggtaagtgaactaagccagtcataggaccaataccgcatgattgcatttacatgagatatctaaaatagtcgtcaaactcaagaagcagaggtggttgtcaggggctaagggaaaggggaaatagggagtagctgttcaagggttataaagttttaattgtgctatttttgttctcattttccagatgccagaactgagggttacagtaaattaagtgacttgaccaaggccacagggctagtcagtgggagtttttgaagttgaaaccagacattcttgctcctgagcccacacttttgaaaccacttaaaattttattgagctgataaactatataaatttgcatatgaggggccatcatacaccagacacaattcatacaaagaaaagaatatctaaatatatactagtaaaaaactttaatataaaaatggagatttttttaagcagataaagctaaaatatctaaaaatgaagaaaaattaatttggcttcacactttataatttattaaataataaaaacatagcgaaacatcatctatatagctttaaagggaaaaacttttgacccaagactctagtagtctttcaagttttctaagtataagcaaaaaaaaagtgtcatataagaacttacaaagtgtatatcctcaataaattgaatacataaataaactaagagatgcagcaaatgcagagcttaagagtggatgggtcagaatataaaaggagtgttgcacgtcatacataggtttaaatatggaaaatataaatggctgtttaaaaatgcctaggaaatataattaaggcaccataaattatttttaaataaaatgtatgtgactaattcttcaaagaaaatataatgaaaataaacttacagagttaaaaacaaaaaggtgagtcataaataaatgtcatgtccccagatgcctcagacacatgaaaattaaaagagtaagaaggcagcatcaggagaccagaggccaatttaccatgaaggccgcccatgggttcctaatcaacagaactatggtccttcatttaaatttcattgtccttaccctgtctgcaaagtttttcaccattcatttccttctctccattgaaaacttcttttcacctgtaccacattactagcaggtttcccttccatcttgtcagtctttaatttctctggctctttccactaatcagtccttgacatatccccaaattctgagagtctatttccaggtttttctcttatctaattatgttttcattcttagagaatggatttactttcagagtttgaacctcaactcaggtaactcctgtgttcacgtttcttttttaagctcttagtctgatattttctgcccgatccatcccaggctctttaaatgcaaccacatcatccccgcgtcagatcaaagcaatcaaagcagctgcggcaactcaatacctatcatctagggtccttctcacggagttgctgatctgtgtgaaggcaaccttagcctcacactgccatctgcctctagcctcccctcagcattaggtttcatgtactccttggtttgataactgggcaacagataaggtttctgccagccccatggtacagctccttcagcctccatcctccacacctgaggccgaggggatgggggagggtgtgggtgccaatttttctcattctatagatagttgcactcagatgttttgaaatcatttaaaatttaatttgtcctaaaagtgacctcaggctgtgacacagtctctaggctatgttaggtctgtgtttgattgtagggctacggtccaaacatagccaccatgcaagaaaatgaacgaattgcaaagaggacaaagataagaccaggaattatgagtggcttaatttagagggtgttaaggccaagaatccaggtcatgagaagccaagataccctttcagagggtctgtttccatttcccctggcaagacactcagaataaagaatatcatttaagccataagggaggtctgtgggccagtcccagagaaagtctattatatttcactcaattttcttggaaatctgtcttgtttaaagtatgttgggacccaggtcctgtgaggtatattcttattccccactcccgaaatatgtgaattattgatactgttaaaagaaaagctttagacaaatttaagagtttaattgagaaaagaaaaaaaacatgatttccaaatcagcccctagaatcaaagaaaattcggagagactttggcactgtcacaaggtcaaacatctatgggaaaaaaatgtgatgtgcaaaaactaaaactgagatacagaaacagctggattggttacagctcagcatttgccttatttaaacaaagtttaaacagttggccgcctatgagtggttaaagtatacctactggaattggctaagactaagctgtcattacagggaaacatactactaaagttaggcttttagtctgtttacctgctaagtatctgagtatggacattttccaggctagattttagttttatttagtaacacattatgggatctgaaggacacttttttaaaggttgaaacaaacaaattttacgcacatttccatttataacaaaagaaaaatgcccctttagctctggtaagtatgacaatttctaaattaaaagagcattatttacatctgaattgttaattctaatattaatttcaagtattattaataatataatcatttttcactaagccttcccttttatacccgtttacactttcaaatctaattatattccactgttgttttaaagatcaagccccaactgtttcatggtgtaccttctttctaattaagtatttgagacaaatgggagtcaggctgggactatagcatgtcaattttcacaagctgacattcacagtaaaagtagttcttgattatttccctaacagctttgatgttaaggggaaaaaaagcaacaacaacactgagctgtgtatattccctcctcatgctcctgggtgagaaatcatagttagtagctgctgatcttaaaaatcagagtctctgctacattgttagcaataatctaaatcaatacagactaacaacacaagccagtatgtggtgagtcatgaaaaataaatcagtagtgatatcaattgaaaatgataccaaaaaactatattatctggaaggaaaaatacaattttataacactcttggtcctgaatagttttgactatggcacacaaagcaagcaagcagcgaattacatgactgttactttctttctactgttagcaccctccgctaatagattgtaacagaatgactgtttggagggttaagcattgggaaatgtccataattacatagcatgtttggtaacatcgtgacattttaataaaacacagatatacattatagaaaagaagatctagccatctttttacactctctagagatcaataaatgtacccttgaatgacagatgggtgttgaaacccctttgcaaataattcctcaggtagctcttctaagctctgaaacgctacaatagttctcaaaatctcaacagagggaaataaaatacttcacagttgtaatgattttctctttatatatatactttctgaaaaagtatagtgagaatactaagtatttgggaactgattttaaagtccataactattaaaaattgcaagaatttttatggagcatatttatttcataaatcagtattaaagcctgaaaaaagaagtcttaaaagtctacataattctcacaatgttatatatatgttatatatatatatgttctatatatgttttatatatgttatatatataaagaacatatttctcacaatgttatatatatatgttatatacatatatataaaagaaagttggtcaaaattgttcatattgagaggtgacaacatgctggtggccctcacttgctctcagcgcctcctcggactcggcgtccactctggccacacttgaggagccccttcagcccaccgctgcactgtgggagcccctctctgggctggctgaggctggagatggctccccctgcttgcagggaggtgtggagggagaggtgcaggtgggaactggggctgtgcatggtgcttgtgggccagcacgagttccaggtgggtgtgggcttggcgggccccacactccgagcggccgtctggcgccaccggccctgggcagtgaggggtttagcacccgggccggcagctgcagagggtgcactgagtcccccagcactgcccgcccgcccacgctgcactcgaattctcgccaggcctcagccacctccccacggggcagggcttgggacctgcagcccgccatggccgaaccccccccacccccgtgggctcccgcgcagcccgagtctccccaacagggtgctgccccctgctccatggcgcccggtcccatcaactgcccaagggctgaggagagcgggcgcgcggtgcgggactggcaggcagctctgcctgcagccccggcgtgggatccactagccaaagccagctgggctcctgagtctggtggggacttggagaacttttatgtctagctggaggattgtacatgcaccaatcagcactctgtgtctagcttggggttcgtggatgcaccaatcagcactctgtatctagttaatctggtggggacttggagaacttttatgtctagctaaaggattgtaaatgcaccagtcagtgctctgtgtctagctcaagtttgtaaatgcaccaatcagcaccctgtgtctagctcaaggtttgtaaacccaccaatcagtgctctgtgtctagctcatctagtggggacttggagaacttttgtgtctagctaaaggactgtaaatgcaccaatcagcactctgtgtatagctcaaggtttgcaaacacaccagtcggcactctgtgtctagctcaaggtttgtaaacgcaccaatcagtgctctgtgtctagttaatctagtggggacttggagaacttttatgtctagctagaggattgtaaataccccaatcagcactctgtgtctagctcagggattataaatgcaccaatcagcaccctgtcaaaacagaccaatcagctctctgtaaaatggaccaatcagctctctgtaaaatgggccaatcagcatgatgtgggtggggtcagataagggaataaaagcaggctgcccaagccagcagccgcaacccgctcgggtccccttccaccctgtggaagcgttgttcttttgctctttgcaataaatcttgctgctgcttactgtttgggtccatactgcctttatgagctgtaacacttgctgcgaaggtctgcagcttcactcctgaggccagcgagaccatgaacccactgggaggaatgagcaactctggacgggaggaaggaacaactccagacgtgctgccttaagagctgtaacactcactgcaaaggtctgcagtttcactgttgaagccagcaagaccacgaacccaccagaaggaagaaactccaaacacgtctgaacatcagaaggaacaaactctggacacaccatctttaagaactgtaacactcagtgcgacagtctgcggcttccttcttgaagtcggtgagaccaagaacccaccagtttcggagacaatattaaacatgttccaattactactctactttaaacaagaaccttataaattcctaaaatatataaaatataaggaatggtacaaataatgcttcacttgttggagatgaagtgaagatgaaacataaaccctatttatttatcccaattattccatgttcacatactcacaaaagactattctgtcacaatttaaccctgttccccaaaatctcctcataaatgcagtttcaaaaagaacaaaactatgcaaataaacattacacctgtagttttgttctgtcaaatttgggaatgaaacgtctctggtgaaaagaaataaacggttagccatttttaatttcaaaaatgatcagtcattcactattcatgtctcatgtgaactacataatgtcaacgctgtcacgaaagcacggtagaaaaaagagatcctctcagcttcaatttagtagagggaaaagttcctggaatatgtttttcctccctctggagcacttcagttttgcaaaacatgtattttataattcttattttgtattcaacaatagtgctctctctggctttcagagtttttccagtttctctgatatttcaaaaagttatggtgttgtcattttatagtttaacatgagtggttctcacttcattcaaaagaaacaggataccttgaaaacgatgtggccaacctctagaaatgaaaattattattgcttaataatagtaatacctaatatatgcaggggcagaagcctggttgagcatgtatatacatcaatcatttaattctcatagcccttacatggccaaactaagtcttggagatattaagaattttttctacagtaatacaaaattaaatttctggaagtctggcacattttgtcaatcctgaagaatacagaataaacgtttatttattcacctattcaattattcaacaaatgtttcctggcagactagtaagtagcaggcttagagttagacatgagaatacaaactgaaataagttttgattcctgtcctcaaggaccttacattctagtttggaagagagactattaaataaacctacagtgttaagatagatacttacagccccaggtagtggtataggatccctgaagagtatgaaattgaaactattttcttctaattaataaacatttataacagtaacagagtagaaaacacttggcaagcctatctgaataataattattctgtctttatggtaccaacataaaataagggtaaaaagcataacatttaaaaaaaagtaattatgtaatatagtaatttcaaaaacgttcatggaattgagcttttacttaggattcgtgtaggtgcaaccaaattgcaactatgctcacttaagggtcccagtttgcaacaatgattcaaaagctcaattctgatcatagctatatcaaaagattgttggtgtttccaggggcaaaactgagtctgataaatatatactcaataactgaaataaatagattcagtatttcaatggaatgactggcatccactttctatctaatgaaaggccaatatcaattattaaacgctaaaaattactactgggagtgcaaaactgaaaacctcttccaaagaaatatgaaatttaaatctggcaattttatttaaaagagcttcaaagtgtaaaaacagagctttctctttacataaatacttacgataagtaatttatcttctttatagaacagacaacagaccaagacaacttttcgcaccttggtggatgcgctctgaatgccaagccaggcaccacagtcattactaccaaaggggaagtaataaatttactgtctatacgaagactttcaggtctgtcccatgtaggtgaaaaatagcgcgacttttaatctctcatcattaacgccattaaactctatattaaattctgtgctgatgaaaattttttttaaatgtatgttagtattgtgtttccttacactcatttattacagagtgttatggtttctatttgcaattctgtcttttctataaaattttcagtttcttgagagcaaaaactggttgccacaatgaccagtatatagttggtgctaaaaacacatatgttgaataaaattgaatacatattcctaatttcaaagtaattgtacatgttacaatgtacttaaaaaacagaaaaattgccagtttcacattcactatctttattgatgggttcaagtctatgaaatttttgcctatcatatatcccaaagcacaataaagcagtttcaaagacattttaacacacttaagaaaaggagcttctgaattaaagcccaccactttcatattaacattaatacattttgattccatatagtcacaatagagtttataagacttgtccaaatcgaagctgaaaaatgttatgatggccattcacttttaattaaatacaagcattaaaagaaatactatttatattagcaatagaaaacagaacttctaaatcacttataagattcaggattttattttcttactcttctaaaatagttcatttaacttttatttgtatttttctaaaatttatcagccaccaacttacagtgtgagcccactcagagaaaaatttaaatcatcaggataataattaatatttataaaacaaggtatttatagaaagcttttttatatgtatactattaattatacatggtattttatcactctcactataataatattttaattaaaaccttgccttgaaagataatttgggatatctcaaaaaagtaaagttctatatgataaaagaatgttaactattttctgtaagcaatcttaagctttttaatttaccaaaataaacacattcaatataagtttcatgtgatatgttgatttggagtttgctaacaaaatagtcatatatgcatacagtggaaaatacataaatttaaaacatatccagattaagtgaagcttacaaatggagacaattcatatatatttatcattgttagataaattagtaattagtacattgtgcattctagaaaaacaaaaagcatattctttgtctaggttcaataatagtcatctgaaatatgctctgtacctgtggatgaaataagtaaaagaacataaaatgtatgaataaatagggtgaaatttacagagactacttttgctgtcttgtgattcggtcatttatgagtgttaaggatttttctcagtacagttcagaatattaatcaatgccttctacttacaggagggtctgcatcttcagcataaactgttgtgataggtgtacccttgactgcatccggagccaccatccctttgtatattcgtttactaaagacaggaggataatcattcatatcctgtaaaacacaattaggagtttagtacttcagttgaaaccaggttagggatacagttactagattgactcccagtcttcatatcacacaacttatttaccactgtcagccttccatcctctcaattccattactctcatttcagactggcacctcagaggaaactgccagagttctcatacaatattaatgtgtggatatcaactgaaggccgttccactggaataaagtctttcaccctcaaaaacatgccttttggagactgaagtgaccctggaatttttttctaacttctaatggtaagaggtaaaattttaacatttgaaaataagaacaagtttctttaaaagctacattctgtgaagcaggcgtaaaagattttttttaaatgctctttatatgtttttatagcaatgtaaattattttatatacttagcataatactgactagaacatttcagatacaaactgtgaaatatcctttgttgccattttacatgataaaaggagattttctctgcagcgcactaaaataatgacacttaagattagatatatttatacacagaaaacaatgttaatttactgaatttttttcagagcaacttatatgtatcttatttttccaatttggcgctatatatgcattgttattcatgcattgtcaagttcattaaataaatagttatcaggtatttcccactttcatcagatatttagcacttcagtgcgaggcactgaagatactgttgtgactcaagaaaaagatgtccctgtctttgtgtcacttaactgccattaggctagtaaaaatactaatctgcagaaaggctagtaactttgactaaattaatctacttatcagggccaaaataataaatcaagtcccctgaaaggaagaccatatttttctgaatcattttatcttttagagataattgtatataatcttttgtcaataaataatgcttattcatatggcagatttatttatttataatattttaataatccttaccctaccgtgttttgggtagtgtgggtcaaacatatttgaactgaaacctaaatttgttaattatctgctcttctcctccaagtcccctttttctcacttgctagtaaaaacaaaatttaaaaaattctacatattctttgatatttgcttagacacaacaattttcctgtacagtattaagctggaaacacataaattaacagatctcaaacttctctttttgcaaagaagtcagaataattatttcttactatcaaacaatgcttccttttatattcgccatagagttgagttctgagtagtcaatatgaataaacctgcatattctaataggagaacttgaactgtacacaaaactgaaaaataaaaaatatcatttcttctgttttgaaatacagtattcaccatctcttctatgaaaaatatttttacaataaattatggactttagaatctgaacaagtaaatgaaccgagaagttttagttctctataatgaggactgtgaagggtattgatcttgaggctccatgcagggagtaaatatataaaacattagcattcacacattttcgtgccctttccaagagtgccaattaacttaataagtggatgtggtaactaagggtgtggaaatcctttagcacccctaaattgtaacttctgaaggttcgaaaggaaggagcccaacactgcaatgtttccatgcatgagtttccaatgagctcattatgttcttaaaaattttattctttattttattctcaggggaaatttaaaaccttaatgtcacaaggtactttttggaaaatttgattcttcagaaacaaaaaaaatgtatatacttttccaattatgtcaacacagctgttcacagtgttgaatatgatgaactttttatttgcttgggaagtattcattggattcaccttctaacttgaatgtacagtgattcacaaactgattagacacacacctaagactgtaaatgactgaagcctatgaaaagattggttctcttccccctttattttctattgacaggatgaagaataaattaatgtagttattgtagtagtatttctttttatggcacgttgtacatactttggggttataatctttcattgtggttacaaaagcagctagttgcatatagtttttccacaatgcattatttcaagaggagaaatgtattgaaatgcaattccaacaagcataatcaatagttcactgtatttatgctcagggacatctgaacaaaaatgtatataaatcggcttctgtgcaaatgttctcttgtgcagtaaattaaggactcgctcagcactccaaaaccatgctcttttctcttgcccattattccactagagggtagtattagcaaaaagaaatatttcctcctctgtagttaagaattgtatcactaaaacccataatatttgtttcttttggtaaaaatttttattggtctcaacaaaaaatagttttaatgcttcaaaagagtattctgaatgttatgatttacaacttgaaaaaccttatggtttttttcttaaggaaaactttaaaaaatggttatactcataaagcctgcaatttgtttccatgtgtcaagcaaataaaattatacctgaaggtgtaggtagctaacaggagaaaactatgttttatttatttatttgctacattagagtctgtaataatcacagaaaccttttctcctttagcagactaccaagaagatgtaaggaatctttttaatgatcatgctaggaagataagaacttgctggtaagtttgtaaatgtaatgacaagttgaagttctacacacacaaaaaaaataaaaataaagagaaaaagatgataaaatttttgattttctggaatcacaggcaaaaacctatagaacagtttttatttagaagataagtagaaagttctaactagttggaacttgatcatctttttaaaaataacgtgtaggctgggcacggtggctcgcatctgtaattccaacactttgggaggctgaggtgggcggatcacccaaggtcaggagttcgagaccagcctggccaacatggcgaaactgtgtctctactaaaaatacaacaataagcctggcatggtggcgggcacctgtaatcccagctactcgagaggctgaggaagggagaattccttgaacccaggaggcggatgttgcagtgagccgagatcgcgccattgcactccagcctgggtgacagagtgatactcagtctcaaaaaaaaaaaaaaaaaaaaagatatgtatatagcaaatgccagtccttaccatactaaagctaattcaggctctatgaggagacacagacagtataagccaatgggcggaatgactttagttgtttctgtcttatggtctagcattagcattatccttgttgagctatatggctgctctataatgccttgaggtttatggagccgatacctacttttacgtgggtgtatggttgattgtttgcctcttaccagttctgttttccactactagacactttctatttgctgtccaagttgctgtttctcatatttctcatattattagcattctgctgggtttttttctctctcaatttctgtattgtctccttgtctttactgacttatttcccttcttttatgcttctgcataaaaagtcataaaaggctacatctgcagctaaagaaaatatttgatatttttactgccaggctaggcatattcaccacaagctgatttaagaggccatgggccataagtgaacattggtggtagcctggcagtactccccaagggtctttgatagtggcacagggtaaggctcctctgcttgtggagaaggactgtttctcataggttgagtgcctgctcagccacagtacacaagaacacaaggtagaattctaaggttttgacttccagacggtaactttgaacctgttcagggcctgggagatttttgccaccctgaagggaaagacacaggtctggctggctttgccacctgctgattatagagacccatggccttgaacaaacttaagtggtagccagggtggttacagcaggtcttggacaagacccagtgctgtgctgggtttaggtctgacccactgcagtcccagcagtggggtccacaggggtgcttgtgtcaccccaaccccagctccaggtggctccaaacagagacactctgtctgggagagagcaagggaaaagaacaggagtttctgcctggtaattaagggaattcttctggatcttatccaagaccattaaggtagtaagagtctgccaagaaccacagtgttactgggcttgtggtgcctcctaaagcagatacagctttagcaacacctacatcctttcaaatacctgaaaagctttccaaataacaaatacgaagaagtccagactgtgaagaatacaataaatacccaacgcttaaatgcccagacacagacaaacatccacaagcatcaatatcatccaggaaaacatgaagtcaccaaatgaactaaacaagccaccagaaaccaatcctggggaaacagagagagtgatctttcagacagagaattcaaaatagttgttttgagaaaactcaaaaaattcaagataacacagagaagaaatttagaattctatcagatacatttaacaaagagattgaaataattttaaaaatcaagaagaaattctggagttgaaaaatgcaactgacaccctgaagaatgcatcagttttttaatagcagaattgaccaagcagaagaaagaattagtgagcttgaagacagcccatttcaaaatacacagtcagaggaggcaagagaaaaaaaagaacaaaatcaatgaaacatgactacaagatctagaaaatggcctcaaaagggcaaatgtaagtgttattggcattaaagaggagacagacaaagagataagggtagaaagtttattaaaaggaataataatgaagaacttcccaaacccagaaaaggatatcaatatccaagtacaaaagattatagaactaccagcagatttaacccaaagaacactagctcaagttatttaataatcaaactcccaaaggtcaaggataaataaaggatcctaaaggagtaagagaaaagaaacaaataacatacaatggagctctaatacatctggcagcagacatttagcagaaaccttacaggccaagagagagtggcatgtcatacttaaagtgctgaaggacaaaaaaaattcctagaagagtatatctggttaaaatatccttcaaacaggaaggagaaataaagactttcccagacaaataaaagctgagggatttcatcaacaccagacctgtcctataagaaattctaaagaaagttcttcaataaaaaaagaaagttcgtgagtaataagaaatcatctgaagatacaaaactcactggtaatagtatgtacacaggaaacacagagtattataacactgtaactgtggtggtgtataaaatattcttatgttaagtagaaagactaaattatgaaacaaaaataactacaatcacttttcaagacatagtaaaataaggtataaatagaaacaataaaaacttaaaaagcatggagatgaagtatagagtttttattagttattttttcttgtctgtttatgcaaacagtgttgttatcagcttaaataaagggttgtatgatagtatttgcaagcttgatgataacctcaaaccaaaaaatgtacaatagatacataaaaaataaaaagtcaacaaaatcaaagcaccagagtatactaccttcacttaaaggaagacaggaaggaaagaaagaaagaagacaaaccataagacaaccagaaagcaaataacaaaatggaagcaataggtccttagttataaaaaataacattgaatgtaaagggattaagctctctaatcaaatgacatagagtggatgaacggattaaagaaaaaaaagacaaaatgatctgttgcctacaagaaacacacttcacctataaagacacacatagactgaaaataaacacatggaaaaatatattccatgctaatggaaaccaataaacagcaggaatatctgcaattacaggaaacaaaacagatttcaagacaaaaactacacagagagacaaagaaggtcactatataatgataaatgtatcaatttatcaggaagatataacaattgtaaatatatatacatatatgtatatatatacatgtatatatatacatatatgtatatatacatgtgtatacatacatatgtattcagtgtgtgtgtgtatatatatatacacatacacacacacatatatattttcaacattggagagctcaaatatataaagcgaatattattaaagctaaagagccagatacatccccaaacaaaaatagctggaaacttcaacatcccactttcagcactggacagatcttccagaaagaaaatcaacaaagaaacatcagacctaatctccactgtagaacaaatggatctaacagttactcatagagcatttcatccaacacctgcagaatacacattctcctcagcacatggatcattctcaaatacaggccataccttaggtcacaaaacaagtcttaacacattaaaaactttgaaataatatcaagtatcttctctgaccacaacagaataaaactaaaaatcaataacaacataaattttggaaattatactaacacatggaaattaaacaatacattactgaataaccaggggtcaatgaggaaattgataagaaaattgaaaacttttttgaccaaatgataatgaaaatacaaagtatcaaaaccaatagtgaggtgtggagttggcaggacttcctgggttgatttggggactttcacaaaagacccctgtgactcagggttttgagttcttaatcaataaagtgaaggattcaaagttaaccactccaagggaggattgaaaaaagagccactctcaatggacaaaaagaaagaaaggggagggggtaacacagggatataagtcctagccaccacagccagcagtggcaacccttccaggtccccttccaccatgtggaagcttccctttcgctttgttcaataaactgtgctgctgctcactctcctggtctgtggactctttttgagttgtaacactcactgtgaaggtccgcagcttcattcttcgaagttagcaagaccacgaatccatcagcaggaaaaactcttgattcaataggatatactgaaatttttactacgtgggaaatttatagctataagtgcctacatcatgaaaggaaaaaaacttcaactaaacaaaacaacctaatgatgcatctttaaaaactagaaaagcaagagcaggctgaagccaaaattagtagaagaaaataaataataaagatcagagcagaaataaatggatttgaaatgaagaaaacaataaaaagatcaatgaaacagaaagtttgtttttttaaaaagttatataaaattgacaaacctttagccagactaactaaaaaagaagagagaagacccaaataaataaagtcagatatgaaaaagaaaacattacaactaatactgcagagattcaagggatcattagtggctactatgaacaaacatatgtcaataaattggaaaatcaagaagaaacaaataaattcctagacacacacaacccatcaagattgaactatgaagaaatccaaaacattgaacaaactagtatcaagtaacaagatatagcaaataacaagtatcaagctgtaatgaaaagtcacctagcaaaggaaaagccagaacctgatggttttgctactgaattctaccaaatatttaaagaagtactaatactaatcttactcaaactattccaaaaaaaaaaaaaaaaaaaaaaaaacaggaggagggaatactttcaaactcattctataaagacaataatactgataccaaagctagacaaagagacatccaaaaaagaaactataggcaatctccttgatgaatattgatgcaaaattcctcaacaaaataataacaaagaaattcaacatcgtatttaaaagatcattaatcatgaccaaataagatttatctcagggatactaggatggttcaatatattcaaatcaatcaatgtgatatatcatcaacagaatgaaagagaaaaaccatatgatcatttcaattgattctgaaaaagcatttaataaaattcaatgctctttcatgataaaaaccctcaaaaactgggtgtagatggaacatacctcaacataataaaagtgatatatgacaaacccgtagctactcccatactgaatgaggaaaaactgaaagcctttcctgtacgatctgggacacaaccaggatgcccactatcaccactgttattcaatatagtactggaagtcttagcaagaacaatcagaaaagaaaacaaaataatgatcatctaaattggaaaggaagaagtcaaattatccttgtttgcaaatgataaaatctaacacttggaaaaacctaaagactacacacacacacacacacacacacacacaccacacaaagtattagaactgataaatttagtaaagttgcaagatacaaaatcaacacagaaaaatcagtagcatttctatatgccaacagtgaacaatccgcaaaagaaatcaataaagtaatcccatgtaaaacagctacaattaaaataaaatacctaggaattaaccaaggaagtgaaagttctctgcaatggaaactataaaacatggattcaagaaaatgaagagaacacaaaagaatgaaaagatatctcatggtcatggattgcaataatcaatattgttaaaatgtccatactactcaaagcgttctacagattcaatgcaatccctgtcaaataccaatgacattcttcaaagaaacagaaaaaaaattctaaactgtgtatggaagtacaaaagacctagatagccaaagctatattaaacaaaaggaaaaaaaaaaacacctggaggaatcacattatctgactttaaataatattacagagctatagtaaacaaaataggatggtactggcataaaaaaaaaaaacacacatatatccatggaacagaattgagaacccagaaataaatttacacaactacagcaaagtcaattttgacaaaagtgccaggaatgtaaccagggaaaggacagtctcttcaataaatgatgccaggaaaactggatatccatatgcaaaagaagaaattaggccccatctcatgccatatacaaaaatcaaatcaaaattgattaaagatatgaatctaagacctcaaactatgaaatgactgaaagaaaacatgcggaaactctccaggagataggactaggcaaagatttcttgagtaatacctcacaagcacaggcaaccaaagaaaaatgaacaaatgggatcacatcaacttaaaaagcttctgcacatcaaaggaaagaatcaacaaagtaaagagacaacccacagggtgagcgcaaatatttgccaactacccatctgacaaggaattaaacagaatatataagcagttcaaacaactttgtaagaaaatatctagtaatctgattttaaaatgggcaaaagttctaaacaaaaatttctcaaaagaagacatacaagtgataaaccggtatataaaaaggtgctcaacatcattgatcatcagagaaatgcaaatcaaacttacaatgagacaccatcttacaccaggtagaatggcttttatctaaaagtcaggcaatggcaaatgctaataaggatgtggagaaaaggaaccctcacacactgatggtgggaatgcaaattagtacaaccactatggagaacagtatggaagttcctataaaactaaaaatagagctatcatacgatccagaaatcccactactagatacatggccaaaagaaaggaaatcagtatatgaaagaaatatctgcactcccatgtttattgcagcactatttaccatggccaagatttggaagcaacctaagtgtccatcaacagaataatggagaaagaaaatgtggtacaggtacacaagggagtactatttaaccataaagaagaatgagatcctataatgtgcaacgacataatcaatgaaggttaaaagtatatgagagaggcactttctggtgtctcccagaaaccagtgggtgatatttatggagccatgggagagattctttactacgtagatatactatttttaatcctggacatgcacattttctttgttttctctggtttggatttttataggaaatatgttatatcttagtcctaaaactctagaatagtagaattaaagatattttctcctgctatcaccaagttcactgacaaatataatataaagaacacaccaataggaatctgaaaatgcggactagaagagagggaaacatttgaaagccatacttcaaagcaaccccaacagaacaattagcaagttgtaaaaaacaatattaaatctgaccatacaccaactagctggttcacagaaattatcatttattcaaattcccacctccagacaatacctcttacctccatacaataggtatgctgtagatgaaatgtccagaatttctgttttgtttgagtctgggacaacctcctggtctctcaagcatcagcttttctgatgaaatcaaaagcaggaccctatcaacactgtcatgatggagcatcagtagcacgtaactgcctctcaggtgtccacggtttcacaaatgctgccttggtactgggcactgagttttcatctagaaaagctatcctttttcttctattctatggggtagcaatatttctttctggagaagaaaactcctctgaaaggtggaaatcttagcttcattttccaagactcactgtgtttaacaacaacctcagcccttgttacaaggtgaacctgatgatacttcatttctcgtcatttcacccctccctgcctactcccacacctgcacactaagacaggcaaacacaaccaagggtcaatctagtctcccgtcttcacagaagcatgtctccctctctcctactcccatgcagccattctatccaaaattataatgagcaaaatgacttgggtcatctgtttatctcagacaagttctttatactccttataatgctgcttagtataatatatccatttacatattcagcttttcagattcatattcagttttcagtttgctgtagaacagcccttttctttctgtgtattttctatattatgttacaacgcagactctaagaccaggtttctattataacttagtttgtaaggctagttatcactctggatcttttaaaattgtttagaattttattttcactttccagagatttgcttatatcatctaatttactatcatcacagattcagttcttctaaatatttagtatatctagaaatatacaagaaaaatatttacaagtaaaatacacaagaaaatatctctaatttactatcatcacagattcagttcttctaaatatttagtatatctagaaatatacaagaaaaatatctacaagtaaaatacacaagtaaatatcttgtatatacaaggaaaaagccttgttacattgatgttctataaaatcttttcaagaaaaaatgtatgttatttgtttgatcatcacaggttttgttttggattcttaaaacttgacactaagaaagctgtgtgcagatgtcttgataaaaatttttatttatactgtggaaatattgtttttccaaataatacttgaattttcccattcttgctccaattttaaacaggtttgatggactaggcattaaacacttcatcttttattttttcctcttgtttacaaaagaaattatgtttctgctcattttgaaagaaagaacttcaagatgttttcctgtggtgactttttgggtccaagtatctcctagcgaataccatacaattatgttatcaacaaaacagcttttcagtactgcgagtaattagaccaagtatagacaatttgaaaagctggtaaagactacatttgtagagaactgagaattgtactccattcttctcttaaaaaaaggataataatattttatgggcctcagtagtatatactagaattttaaagttatatttgtgataatccccaccctgagttatcagaaaagaggaaagcaagtgtcagtctacatttgggagaatttcctacaaattttattatgcttagatgaacttggaataaaaaagtggtattacatatgtctagagttaaatgttaagttttgctttaaatgtataataaataggcaatgactttgcatgagtcaggacgccttgaccaaaggaatggtgtgatttctctaaataagataaagcaattgatacaacacgaattaaaccaacactcttctctatctgaggaataaattatcttccagctgctgatgtagaagcgttaagtaatacccccatattgaaataaagggatgttgaggcaacattaagaacttttttaaagaggtatgaggcccagatacagaatgagggttacttagggcatatcttgctttttgaggtgataattttggacataatttaactcccctaacattttccatcaaaacaagccaagcaaatatatccaaattgaatccagagctgccaagtcagaatctatgagtgtttaccataactgtctgtcatcaaccacaccctcatcagagaaaaggccacaccatttgaggatctatttttcgatctgggaagaaaaggggaaatgtcattaatagcaagtcttttttttctcttctttgtccaaaatcatcaataaatgaattatttttctatttttaatgttttaactgttcaattccaccaagtcatatgagtagacaagagtaaaccaaggcaaatttttcacctggtccagaagatattttgctatttagtctatatagatcactctcaccttagtctttttcatctgcttacatattatggcatcttcataaccaccaatattatattccctaaatatttttgtaacagatttctaaatgttataacacaatagtgtgacaaaatcatatttcaaaatacaatacaatcaaagccctcccttcaggcaatccataattttgtcttgtcccttgatcctttttccagaccactagagcactgataattattgtctcgggaaagagaggtatgaaaagaaaaatcaggttaccccagaaaagattttgacagtttgagttcctatttccaaagaaaatttagtactgaataaagttttaatttcctgaaatagacacatttcttacctcctgaaataaatatcttaggacagagagacacaagaacggaataattaagtatatagacatgtggacccccgagaaataaagaacccagatcctgataaaactctcccaacaggtttagggtgtccgaggatggaaggagcttacgatctccattccaaggtagtttagaggtggaaacagtatccatagaagaaatggcatcaatttgtgtgctagcagataatccaggtcaagtgtaaaaaaagacagcgaaagaggtgggggccaagagaactaactagagggagctggtgtgtgtcaatctcattgagaaaagaaaggctggcgagtggacactagctcatctgaaaaatccaggtggagacacactggaattcatcaggaaacagcataacacatagagaacagaggagagcaagacaagacaactgcccaccctggggtggcacagagtcaggggagtcctcccactgtggagaaacagtgagtaagtgagtccctggggacccaccttctgccatggacttttgcatccctggactcaggagatctcccccatgagctccccaccggtgcctccaggctgacacggagaaccatgtggagtcttggcagagccatactcaggcacacagggagtcccaggagacttgtatccccagacactctggcaccagtggctgtagctcctgcagcagtggaggccagacttgcatgcctccagtaaaggggccaaatccacgaggctgagcagtgaaacattgcaggcctcatctcagctgcaccttgcaggataaggcctactgtccattccagccccacctgagttcctgggtcgggagcagctctgtacttctctgggacggagctcccagagggagaggctggctgccatttttgctgctctgcaaccctccctgtttttgctcttaggcttgggagggacagggattagggactaatgccgacccccaacacagcgcagtttccttacagaaaagcgggtaggctgttttccatgtgggtccacacccttgctacttctcaccgggcagggcttcccaacctaggacctcggcaacccccgacctgggctcttgggccagtagcagctctgtactttcctgggacagagctcccagagggcaaggcaggtcaccattttttgctgctccacagtcctcattcctgttgccctcaggctcaggagggaatgtggtggttggagactgatgcaaacgcccagcacagcacggcagcattacagaaaagcagctagactgctttctatgcaggtctctgcctctgctactctttactgcccagtgcctctggacttgggcccctagcacaaccaccttgtcaatgcctaacacttcagtcagtggtgagaaaaccccagagacaatccacaacctctctgtgactgcagctacccttgggctggggaggaacaaagggcttggccactatgcaggaactccagcacaccacagccacaatatggacagaagcccagtgtctgtttcccgtgagcccccacctctcactctttaccaggcagtgcctaagctcgggagcacggaacagccaccccatctccagctgagcattctcactgctagtggctttgtgtttccttaaggaggggctcctacagtcaactaacagccactctgccactgccacagcagtagttctgcccctgctgcccttggactggagaagaaagaaagggccaaaggttttactcactcttccaggaggacacagtcatcatatagagagaagcccagactgtcctccctgtgaatcctcaacctcccgttctttacccagctcaggccagcagtgcagccaccccactccctggctggacattcccagtaggagcagttttgagtttccctcaggttgagcacccagggacaaccgaaagcccctctaccactgctgctgcagtgatattgcccttgctgccctcagactgtggagggagcaaagaccctgagtgctttagccacacctccagacagctgcatcacccacaagcttggtcctacaatgcagccaccacaccccaggctgactgtactgattagtagtggctctgtatttttctggggtggagcaccaagagacaagtgaaaggccatctgccacagccacagccaaggtcccttcccttgttgtgtctaagctggggaaagaacataaagcctgagcttgccccagagctacaatgtgtagcctgggagtgccaaacagatatacagccagcagtcaagtgcaaaaggagccgacactttcagatcactgagaaggggcacaacaatccttaggaaatagaggagactgacgaagagtctacctactggccattccagttaagtgccatctgctggatcacagcccaaactttactattaaaaatattttgctaatatattcttctgtgaaaccaaggacaagagctcagttacaaataaaggtcatgcacaaaacctcactcctctgaaaacatctaaataaaccaactgactgtactcaaattagacagttgaaagaacatcagcgaacacagatgagaaagaaccagtgcaagaactttggcaactcaaaaaacaagtgtcttctttcctccaaacaactgtactagttccctagccaggattcttaactcagctgaaatagttgaaatgaaagaaatagaattcagaatatgggtaggaatgaaaatcattgagaatcagggaggaagtcaaaatccaaaccaaggaaactaaggattacaataaaacaatacaggagctggtagatgaaatggccattataagaatgaaccaaaatgatctgatagagctgaaaaacacactacaagagttttatattgtgattgcattaacagcagaagagaccaaactaaggaaagaatcagagagcgtgaagactggctctctgaactaactaagaaggacaaaagtaataattaaaaaaagaataaaaaagaatggacaaaacccctgaaacatatgggattatgtgaagagaccagatctacccctcattggcgtcactgagggaaatggggaaaaagcaggcaacttggaaaacatatttcaggatattgtccatgaaaacttcccaacctcactagagaggccaatattaaaatttaaaaactgcagagaactgcaagatactatataagaagacaatccccaaaacacataattatcagattctctttcattctttttaaaatgaaagaaaaaaatataaaggcagctagaaagaaagagcaggaaacctacaaagagaacccatcaggctaacagtggacctttcagcagaaaccctataagccagaagagattgggggcctatgttcagcattcttaaataaaagaatttcaacccaagaatttcatgtccagtgaaactgagcttcataggcaaaaaagaaataaaatacttttcagacaagcaaattctaagggaatttattacaaccaggcctgccttataagagctcctgaaaggagtgctacatgtgaacagccactacaaaaacacacttaaatacacagatctctgacactataaagcaatgacataagtctacataatatccagctaacaatatgatgacaggctcaaattcacacacatcaatattaacactgaatgtaaatgggctaaatgacacaatttaaagctggataaagaagcaaggaccaacgttatgctgtctttaagaggcccatctcacatgcaatgacatccataggcccaaagtaaaggtttggagaaaagtccaccaagaaaacagaaaatagaaaaagctgaagttgctatccaaatttcagacaaaaagagactttaaatcaacaaacatcacaaaagacaaagatgagccttacataatggtaaaggatacaatgcaataagaagatctaaatatcccaaatatatatgcatccaacacaggagcacccagattcataaagcaagttcttacagacctacaaagagacttcgatttccacacaatagtgggacatttcaataccccatggacagtaatagacagatgatggaggtgacaaagtgaaaaagatatttaggacctgaattcaacaattgaacaaatggacataatagacatctatagaactctccacccaaaaacaacagaatatacatacttctcatcaccacatggcacatactttaaaattgaccacacaattggacatcaaaacaatctgtaacaaattgaagaagactaaaatcataccaaccacactctctgaacatggtgcaataaaaacagaaatcaatactaagaaaaacattcaaaaccatacaattacatggaaattaaccacttgttcctcaattatctctgggtaaacaataaaattaaggcagaaataaaatatttcaaactaatgaaaacaaagatccagcataccagaatctctggggcacagctaaagcagtgttaagaaagaagtttatagcactaaatgcccacattaaaaaagtcagaaggatatcaaatgaacaatctagcatcacatctacaggaactagagaaacaagagcaaaccaaactcaaagctagcagaagacaagaaataaccaaaatcagagctcaactgaaggaaattgagatgcaaagaccatataaaagataaatgaatttaggaattatcttagttatttgaaagaattaattagatagatggatgaatagctagacaaataagaaaaaaaaagagaagatccaactaaacacaatcagaaatgactgactgaatgaaaaaagacattaccactgaccccacagaaatataaaagaacactcagagactatgaacacctctgggtacacaagctaagaaacccaagaggaaatggatacattcctggaaccattcaacctcccaagtttgtgttaaaaagaaactgaatccctaaacagaccaataatgaattttgaaattgaatcagtaaataaagagcctaccaactaggaaaagcccaggaccagttagattcacagccaaattctaccacatgtataaagagctggtaccatccctactgaaactattccaaaaaattgaggaggaggcatccctccctcactctatgaggccaaaatcatcttgataccaaaacctggcagagacacaacaacaacaaaaaagaaaacttcaggccaatatctttgatgaacacagatccaaaaatcttcaacaaaatactggcaaaccagcagcacattgaaaagctaatccaccacagtcaagtaggttttatgcctgggatgcaaggttggttcaatataggcaaatcaacagaagtgattcaccacagaaacaggactaaaaacaaaaactacatgatcatctcactagatgcagaaaaggatttcaataaaattccacatactttcatgttaagaacgcttaacaaactaggcattgaaggaacatactttaaaataataaaagccatctatgacaaatgcacagccaacgtcacactgaatgggcaaaagctggaggcattctccttgaaaagagaaacgagataaggatgtcctctcttattgccactcatcatagtaatggaagtcctggctagagcaataaagcaatagaaagaaagaaaacccacccaattaggaagagaggatgtcaaactacccctgtttgcagatgatatgattctacacctagaaaaccccatagtctttgtccaaaactccttgatctaataaacaacttcagcaaagtttcaggataccaaatcaatgtacaaaaatcagtaatagcattcctatgtaccaacaacatccaagctgagggccaaatcaagaatgcaatcccatttgcaatagttacacaaaaaagtacctaggaatacaactaaccaggtggtgaaaaatctctacaatgagaatttaaaatattgctcagtgaaatcaaagatgacagaaacaaattgaaaaacattccatgcttgtggatagaaagaatcaatatcattaaaatggccatactgcccaaaacaaagtacagattcaatgctattcctattaaactaccaaaggcattattcacaagaaaaatgtattctaaaattcatatcaaaccaaaaataagcttgaatagctaagacaatccaaagcaaaaagaaaaaagctgaagatatcacatttcttgacttcaaactatactacaatgctacggtaaccaaaacggcattgtcctggtacaaaagcagacatatagaccaatggaacagaatagagatcccagaaataatgctgcatacttataagcatctgatgtacaacaaaataaataaaaacaagcaatggagaatggactccctattcagcaaatgatgctgggataactggctatacatatgtagaaaaatgaaactggaccccttccttacaccatgtacaaaaatcaactcaagacggattgaagacttcaatgtcaaacctaaaactataaaaacacaaagataacctcggaaatatcattctggacataagccctggcaaagatttcataacagagatgccaaaagcaattttaacaacagcaaaaattgacaagtgtgacttaattaaactaaagagcttctgcatagcaaaaacaaaacaaaacgaaacaaaaaaactatcaacagagtaaacaggccacctacagaatgggtgaaaatgcttacaaactacgcatctgacaaaggtcaaatatccagaatctataaggaacttacaaatcaacaagcaaaaagcaaacctcccacttaaaaagtgggcaaaagatatgaacgcacacttttcagaagaagacatacatatggtgaacaaggatatgaaaaaatgctcatcatcactaatcatgagagcaatgcaaatcaaaaccacaatgagataccatctcacaccaatcagaattgctattaaaaagtaaaaaagaaaaaaaaaaacatgctggtgaggttgaggagaaaatggaacaaagcagtttggtgatttctcaaggacctcaaagcaaaatgaccatttgacccagcaatcccatttttaggtatatacacaaagataaacaaattgttgtaccataaagacacatgcacatgtatcattagtatcatgctattcacagtaataaagacatgaaatcaatcaacctaaatgcccatcaatggtagactaaataaagaaaatgtggcacatatatgccatggaataactatgcagccataaaaaagaatgagatcatgtcctttgcagcaacatggatgcaactagaagccattatcctaactgaactaacataggaacagaaaaccaaatactgcatgttctcacttagaagctgaaggtaaacgttgagtacatagggacacaaagatgggaacaacatacattgggggctgcttgagggtggacagatggaggagagtgaggataaaaaaactacctataaggtactatgttcattacctgagtggcaaaataatctgtacagtcaaaccctgtgacacacaatttacctgtataacaaaccacacatgtatctatgaacctaaattaaaagctttaaagaaagaaaagtgttggaaattactcagaatcatttgaattactcacccgaccattccctaaaccttttgaattaaaataataatatgttttcagttacaagagacaacatatgttaagatataacatttattttattttattttttgagacggagtttcacttttgttgcccgggctggagtacagtgctgtgatctcagctcactgcaacatccgtctcccgggttcaagcgattctcctgcctcagcctcctgagtagctggggttacagttgtgtgccaccatgcccagctaattttttgtatttttaatagaggtggggtttcatcatgttggccaggctaatctcaaactcctgacctcaggtgatccacccaccttggtctcccaaagtgtagggattacaagcatgagccaccatgcccagccaagatataatatgtatttatcaaagttttatgagttacaataacaaagacatggaatcgacctagatgctcatcaacagtgaattagataaatacaagggggtacatatacaccatggaacactatgcagccataaaaaagaataaaaccatgtcctttgcagtaacatagataacagcttgaggccattatcctaaacaaattaattcaggagcataaaaccaaatactgcatgttctcacctctaaatggtaactaaatattgggtactcctggacataaaaatagccactgaaaattaatagacagaaattgggtggggtaggaagtgaagaagcgggggttgagaaactaattattgggtactatattcactatctagttgacaaggtcattcatatcccaaacctcagcatcatgcaatacacttatgtaacaaatgtgaacatgtaatgcctgaatctaaaataaaatatgaaaatgtaaaataagacactaaaaaaagaaaaggtagtggaatacttccgtgtttcactgtgactgaagaattatcttaaaaaaataaaatccataccccaaaattttatggtcaagaacattaacctactggaaaaatacagttatactaattatgtattggtgaaatcttttttcacatcattactttgttgtctaagaaaaccactagcatatggctagctatttagcaggataacaatcatactgcaacctaagaaaagtgatgatttcttcttccatcatttcaaataaaagaaaatcttatttgtagtccctataatatgagaattgtagaaaagttgcctatgaccttcttttccttaggaccctggatacatatagtcttctactaaggtccctcagagacatttgtgttgcacatgcagaatctgaatgatctcacataatagctttgctattgtagtactggccactaaacaaaataaaaataaaaataaagaaaaagggagtaatcctcaggaacttttatttttaggaataaatgtatctgcactttcccacagtcttcaggtaaccaacagaatccaaatgatatggaattgtcagtaattatcataggtaaattctgctaaacaattcaccttaaacacataatggactttaactataatcacttcaaaagaacaaatgaaaaggcattcatgggaacaaaatacaacctgaaaatataatactggcaaagattaagtgaacatagatgcctagagttatctgcatgatctccaggattagataacctaacaaagttggtaagtcatgtaactttgatcccactcagctcttacacattttagcgactatatgaagcatgaatagtatcaccatgtagtagacaatatgtggttgccaatatttcattccaatcctatggtatgatcctgcaactaaacatttattaaaaatgtccacatctttccacatttttctatctaagcccatagatttcattgttttttaacatagaaacttgatatctatagtcacttggtaaaatctgagccataattatcaattatatttttgggggtagaacatagatacaactgtgaataaaatataaatcaaaacatgtatactaaagttaaattgtttattcaactaattactcatattcatctattttattcatggtcattgatatactctataggcttctttgcaagtgcttcatttatcttatagatcttctgtctttttcctccctccactgcccttgctctgtgcaggtatctctattcctttctgaccagccctttttcatcattccaagtctattcaggaagcagaaaaaaacactttaaataagacttttttaagtttctattttcttcccttaccaaaacaaaaatttttacaatgtaccatgatagtgaatgaacttttactttatattgcctaagaaattattgtcatgtaaagtcattttttagtaatatactcatttagtaaagtaacttgaggatttttgtatatgtatctttgtaattgaagtaaatttctcaatatgggattcagatgtcttgtataagaaacatctgtgtacttttctcaaatgctgatgtttatgatggtccccatgggacaggtccttctttggggaaggagtagagaaatctgaaagtttaagatgacgctcagaggatcacggtatgtactactatttgagaactgatcaacttacagtacttcttctcatatctacttttgtctcttaaaaatcactagaaattcaaaaagttaaaaatgccatgctctttcaggcaatcatctggcacatggtattataataaatgggataacaaatccagagaggttaacaaagtccccaaggtcatagagcttaaaaagggttgagccagaatttaacctcaattccatctaacttggaagcttatttcattccagaggtttgggccctaaattaattttagggcctaagaactcttggcccttcagagtcatatataaaatttttttagttgaaggatttgtaccaaataattatgcctgatgctgtggaatttgaactaaaatctagtctagagaggttaggacttgatggaagtcacagagctgatgcagactcaaatttccatggtctttgtacacatatttactgcctctttcaaatttatcttttatagtcaaaaatatagttatttcttatgtattcataaatatttccattggaaaatctatgttatgggtctggtaccactgtgtcattaggaattgttatcaaaacatattataggtataatagaaggaacaaaacctacatgtagagagagcaaagcaggcaaccagaagtcatctctagcccttacctttacaatcactgtgacagtagcaataccaggtggcattgttccataaatatcaaaggcctctaccagaaaagtgatacttgcttcttggtctggaaatgcctcataatctaaactccttaaaagcgatagttctcctgtaaatggatgtagtgcaaaaaagtgcttcacttctgggcttcttatccggtaagacacatttgctccaaggtcgacatctttggcctgtaataagcagaagaatagttttattagtgacgttaccaaaataaagaaatgcaggaaggatggaagtcatgcgttagtgcctaggacagcatcaatttaacgaggacaaaaagacacgttttttgtttttgttttttaaaaaagcacattatttaataatttaccagggaagagaaggagggatgggggagagaaagatggaggcagggaggaaaggagggagacagtgagagggagagtcagagagagagagagagggatctttctataagattttgtcattgttgacgttattactgtatctgtttaacttgaaaaatcactaaatgaactatatcacagtaaaaaaataaatattgtcttaaatgactgtttcttattttctactgatttgataatcatgaacaaatattttaaataaaaataaatactgagtgatttccataaacataatagatggctaaagtactataagaaaactgagaaaatataagtagtaattatttgtcacagggatcctataatacatttctagagatcactctaccatacttcctttgatttaactaggatttgagtagtagttacgcacaaggtgctgtagagagcaccaaaatgaatccagacacaattactgccctacaggttatggtctcagagaagaaacaagacacaaatactaaaatagaaaggaaaaaaatgtgacatgctatctaaaagatgttctaaattgggaacgatatcctttagctgaaaggatgggttttcatgggagtcttgtagaatggctatttcactcagcagtacagactggcaaatgcacctcaggtacagaaaaccgaatggagcaagaatgaaaatggggaagatccagagtatgctataatgtgcatttttaaatgcaaacacctcctatggtgaacctcagccttggtctcctccaatcaattattgacttaacaatcagaaagatgctattaaagcatacattttattatgtggtttttcctgcttaaaatcccctggtttttaattcaattttcaatcaacgccattatccttaacatggtaagagccactacattttctagacctttagcccctcacccctcacactttcccatcttccatgattttgaccaggctttttccccccaactactttgaacaatctttcttccttttctgcttggatagctcttacttgtccctcagttcaccatttagaaataagtttctctagcaaatattctctttgccttaagattaggttaggagctccacctctattacctaggccctttgtactgaggacctacgttttaactactaattttcttgactgatagctaaaccagcctgaaaactcgaagaaagcagtaaatttgttttgttcacctttgtatccccaaagtctttgcatcccctaggacagcatgaatttaacaacaccagcaggagacttggcatactatacatactgaagacatgtttgttaaataaataacttaactaattaattaattgacagatgaatggtggaatagatgaaggaataattgttctctccctggccagtatttgccttatttagatttgttaatgtttattgctgagttcaattatggaagggatacagagtctggaaaagtatgctaaaaacattcaagttgtggactgcaggtggaaaaatggctacttttttttttttccaaaacataccttatagaccaactgagtcagtattaaatgaggtggttgcttaaaaatgcagatttatggatcagcctaatctactgaatcaaaatgttcaggactgtgtaatttatagttaaaaacttaaaaaagaggcttgatacagagatgtcattaaaaaggagagttagattactagaagatggcttttgtgtattgaatgtgaaaacaatacagaataatgggtataaacaatatttgtaaaatagaggggaaaccaatttgtaactctctatattttttctgtgtgtacacatttatgttatatatgtataacccacacaaattcatatatatatatgtattttttgacatttgtgtgaacacaaagataaatgtgaaataaatttaatgctgagtactctggaggcacaatgtgggagattattaacttttgcttcataaactattgtattgtcaactgttggaataaacagaatattacttttgtaaattaaaaaactattaaaaagtatatttttaatttcttacaaatagatctttctgcccttaatttttgggatatctttaaagtaggcttgccacataaaatacaatatgcaatattggagaaataataaaaatttattcattgtttatctgaaattaaaatccaacttggtatgttgtattgttacttgctaattttggcacacaaaccctaatagcaaatctcctaatgtaggattcatgtaataaatgctttttcccacacacctctatttgaaggatggtagtcccagctggcaaattctcttcaacaaggacagtgtatgttgaattggtgaacacaggactgttatcatcaatgtccaaaaccttgatggccaaggttagagttgaatgacgagggtgtactgctccatctgttgccacaacaacaagttcatagtagtccctgacttctctgttaagcttcactgctgtgtaaatgctcccattggatgtgatacgaaaaagattattaaagttacccaaactgtagtgcacttgaccatttattccagcatcagggtctgttgcctattaaataaaacaaaaaaacaaaaaaattcacgtaagttttgacgggctactgtaaatgaaggtaacagttaacaaattatggtatttttctaaccaaaaattatttggccctctaaggaggaaatgacaatgacaatacaatgcaaaatttaaaacatgaaaaatattatactttaatattcttcatttaaaattaacataacaaaaacggataatgtcattagcaataacaatactatgttatgacagaaaactcataaaaatactgaatctttgtcttatgattttaataggttttgaattctaaagtgagaaaaaattttgtttgtaattcatttaacataatctgccgagtgacaatttaagattatgtaggtttttgctcactgtatatattcattttatatttatatatgtttagtaataatgttacacattatgtttgtttataataaataatattttattatgttatgctgttatttatgtgataatgtttattataataaacattaatcatatttaccataaataatatttataagtataacctgacttaatcctcatgatgttgttatgagtaaatattattaatctcattttacaaatgagaacactgtggcttatggaaggttacacaagaaagaaatatctcagtgtcccagttcttaacacaatacttcatatataaaagtacttaacaaatgcttgtggaattaatgaacattagatgaaataaaacagatttgaaactaaatctgttccaaaagtcaaataggattaaaactacagtaactgtaatgtatgtgcaagggactctttttcaacattagaatatacatctctgcataagtaagaatgtttgataccataatatacctatatttactgaaaatttgaagtcatgtaaaatcactttgcatcaaataaaatgagaaaatattgagtaaatattcatcgaatgaaatgtaataagaattaatcttagctaaaactcaattgtgatactaattatgaatctcactatcagctactgtatattttgttttgaaaagttccatgtaaaagaaactgaaataaatcttagaaactgtaaaatattatataattatgccccaaactgtcaacaaggaaaggaaggaaaacaagacacttggctgccttatgagccagggacacaaaaatcactcgaggtccataaagcgtggaatgcaatatgatgtattttaacagcacatatgcagtggtatatccagttttacaggcaatggtaaagcatgcagaatggggatgctgaatatttgcatcttctttgaaacaagaatgtctaagatgtgaaaatcatgtttacaacagtgctcctatatgtcataatgccaagcatttcagcaggatttgtctctttgactcatcaaaacacaactgcccctgggagtttgacatctctgaggtttaattctgagaaaagatagaagaattgcagaaatacctgaagagaaaaaatacggtgacagagtagaatagtttctgttgatatagtttcttttacttttatactttgcctagaatttgtcttacgaattattgacaaatcagtcaagctgatcattctagtgaaaacaaccaacactgccttctccctttttcaccaaaaaaagagggtgatctctttttttggtctgaaattactcatcaagtaaatagataaaattgtaagccaagaacaaaatataaatatgttttgtttcataataataatacccttaaaaatttcagtcactttttctgtctatggaatatcttaagatcaaaaaaactaatcatttatgcaattagaaatttaaatgactcttgttcaagttgtttttattgacccatataattgaatatttattatggtagaatggctcaatttgactgatgtggctgtgtgtccgtgtgttttatacatgtccagctgcttaactatacatccactaggaaacatatctaaacatatctaaattagttttgtttttgctcccatagcaaattatcacaaatttagcagctgacacaaaacaagttcattattttaaagctctataggtcaaaaattcaagatggtctcaccagggctatgtttctttctggagactctaaggagaaacaacttctttgctcattcaagttgttgacagaattcagttgctagagtttgtagaactgagatccccacttccttgatggttgtcatgtgaggaccaatcccggttgctagaggtccccatatcccttggttcatgacacatttccaccatttttttttttttttttgagaccaagccttgctctgttgcccaggctggagtgcagtggtgcgatctcggctcactgcaacctccgccttctgggttcaagcaattctcctgcctcagcctcctgagtagctgggattacaggcacctgtcaccatgcccagctaatttttgcatttttagtagagaccgggtttcaccatgttggtcaggctggtctcaaacccctgaccttgtgatccacccgcctcggcctcccaaagtgctgggattacaggcgtgagccactgcgcctggccatttcttccatttttaaagccagcaatggtggtcaagcccctcacattttttgaatccctccctccatctttttccattttatctttctgacctactcttcaggcatcctccttcacttttaagggcatgtaagattacattatgctcccttggacaatccaggatagtatccccatctcagaatttttaaccttgatatatgtgtgtgcacatgtgtgcaagtgtgtgtatactgccatatataaatatatagcaatctatattttaggatgggatttttttttttttttgaaacaggtcttgctctgtcacccatgctggtgtgcagtggtgtgatctaggctcactgcaaccttcacctcccaggctcaagcaatcctcccacctcagcgtcctgcgcagctggcactacaagcacatgcccccaggcctggctaattttttgtatttttatcagaaacggggtttcctcttgttgcccaggtcagttttgaacttctgggcttgagccatcctccccctttggcttctcaaagtgctgagattacaggcatgagccatctcacctggccggataggagtttttagagaaaatatccaagcagatattcattaagcagactgacagtaaatgctaaatggggcatcctcaccaatagagtttcagaattttaaataatcagtttaaattggtataaattacgatatgtcaagtacacacacattttgactgaatctatgacaacttaattcactgaattcaaagctaccatgacaagaagtatatttgatgcttatggaaaaaaagactacaatatctttggctctgtttatatgctggattacatttactgatttgcgtatattgaaccagctttgcatcccagggatgaagtccacttgacagtagatgcagaaaaagcgtttgacaaaattcaacgacacttcatgctaaaaactctcaataaattaggtattgatgggacttatctcaaaataataagagctatctatgacaaacccacagccagtatcatactgaatgggcaaaaactggaagcattccccttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagaggataaaatacctaggaatccaacttacaagggatgtgaaggacctcttcaaggagaactacaaaccactgctcaaggaaataaaagaggatagaaacaaatggaagaacattccatgctcatggataggaagaatcaatatcgtgaaaatggccatactgcccaaagtaatttacagattcaatgccatccccatcaagctaccaatgcctttcttcacagaattggaaaaaactactttaaagttcatatggaaccaaaatagagccttcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgctgcatatctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagacttaaacgttagacctaaaaccataaaaaccatagaagaaaacctaggcattaccattcaggacataggcatgggcaaggacttcatgtctaaaacaccaaaagcaatggcaacaaaagacaaaattgacaaatgggatcgaattaaactcaagagcttctgcacagcaaaagaaactaccatcagagtgaacaggcaacccacacaatgggagaaaatttttgcaacctactcatctgacaaagggctaatatccagaatctacaatgaactcaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaactacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactagaaatcatgctgctataaagacacatgcacacatatgtttattgtggcattattcacgatagcaaagtcttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattgtcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataataaaaaaaagactacaatatcccccagaaagctactctaaaaattttaaggtgactgagacacacatctaatggaaacaaagggaacagaatataaaatgcagagctatttccttatctattcctatgtccccattaaattaaggagcataaataaggtgatgtaagttaagcaacatgagctggctaagcaaggcagttttacttctttactattctagatgaacatgtagatgttaaacaagataaccaaacatagaatcccttattatcagcagtactgtcaagaactttgcattgatgtttaatatttagtcaagcagctcagtgtatgatgctataatgaaaatatatattttcctagaaatcaattaaaagttaattaaatttgttaataagaaaaataacacatctcttttccccttgtactacatcaaagcaatgaacagtaatagctgcaactttataatcatctgtccatggttaacacatttttgtaatatacaccttactatggggcctgatttgtggctactaatttgtgaatgcatattgctgggaaattggctgatagcctgtagtcaaataaagacctcactggacagaactttgaataattgccagaaacaccacttgcaaaccttattcattaacaccaaagttagagtatatgaaagacaaccaagtaattacttaagaaaaaagtcaagggaatttattgaaccaaagttttttgtataatttttgagaagcgattttatagcatgccacttgaaaagggaaaagggaaatatatttcttaaacactaaattcattccccacccctttttttctcattatcttcttagaatggtctgttacacaattctttccatccataaaagtggaagtccattactgggtttgctaccctgggggttaccagtcctgtagagaagaccttaaagcatgcctgtatgggtggaatatactaggataaaacctcaaagaacaggttgatgtttgcactccttccactgagaagtccctgggtaggttacttgtgtaatttacaatgattcatttccatttaaaatatgtcaaatatccattcagattaattatttagatagaaaattttatgacaaaaatcagccccaaggaaataacttgaggacaaaaccaaaatgttatagctattataaaggtgtgaactaccatgtagcacctaattggcccagtgtgaagctgagagagtgctttgctctaccttttgcttgtcctttacagcgatttaagaggtcgtgtacatctttctcactttgaagtgggaaccataaaagctgttgatcagggaggttgggcagtgcatccttcatgacattattagtgaaaatacatttttaaaattattatctattaacttcaaaaagatgtacaatagttgtctttttttttttttttttaaggagctgagctatttcaagggctgtgattattagtgtaaaaggagacaagcaatttaaagactcataatgcaggtaaattttttcactctccacacaaatgcctcataatcattattgaacaatggcaagtagacttactggccagaagataacttgcataacttgaattaaaatcactaaaaacataaccagaatgaatagcttttcattctagtccctagaaatctagtccctagaaaacacatatttaacacaaataatttctcaaggggtcagctattattctaagatacacaataaactacattttatcctagcattcaaggctctacctggtcttgttctaacctatctttatgcatttatatccctcagactaactctctgacacaaactctgtgttttagtcaaaggagtctatttatggtatgaatcaccaccaagaaactctcaagtgtcagtggtttgttaccactgatgtttctttctcgcctatacagcacccactgtgaattccaaatccagctttactctatcttgtctttactcagaagagaagctaaaggagcaggcttcattggaatatgaagctcatgtggtgcaagaagaaaaaaagacatgagatagccaagctgcagcttttaacgcttctgcttggaggtcaacgtatcacctatactcctgcttcatcgttgaaggcaaatcacatgacaaggccgatgtcaaggggtgcagaaattccattccctcacacagtgggacagtgataaatcagaaacacttttacaatgtactaccctggttttccttgaaatgaccatgctctccctcaccttccctgatataggttttttttttgtttgtttttattttcccccaatccaacttaaacgttcaaaacctagcttcagttctacttcatctgggaaacctcttctttccatccagccttctggtccctcttgcacatagcaaaactcactttttattgctatttaagtatgctacgcaattaaataattggcctaaaaatctgtggtgtatccatgtattatgtaataggagacactgttagagaaaagaatctgtaaattgttttgtggagtgtacaatgtatgagaagtggaaagttggagcacagatggaaatatggtagagaaggaaaaaaaaaagatagcaagcaaataaaaataaacaatattcctgtagttgggtgttatttaacgcaaatgaactgaaggtgtcaaattaaataagacagtttaagctgttccaacataacctgcaggcctcttactaagtaagcattaggaagaaactttgcactaaaaacctttacatattcagttctcatgttaatggtaaacacttgaagattatgacatcaatgcttcaggaaaagagttgttgtcatgttcacgctcatacagcaaagaaagaaagtaatgttgtttcatgttcattaaatgtatttacatagtaaggctgtcttttccctttttcaaatattccttatagtgctgaaaacgaagaggaaaacctgggaggactcatttcatatttccccaccattgcttagtatttgataattatgcagtataggttgagtgtgtatatacctctttatgtgatggtaaaaaaaattatatattaaattatatttagttttccaacctcttcttacttctatttctccaacttcttcattctcatctttttctctgtgggcgaacatattcttaccactaaatctaagtgcattttgccatactaaccatgctatttcatgtctgctttatccagtcataaaatcttccccttatttccaaaactgattattcttcagccctagtatcacctctcagaagcatctgagtaagctaaatgcctcatcttcatgctcctgaagctcattgtatgtttctttaccacatgccctattgctttttttctgtcattttttaatagcccacatgaaattaagaattcataaggacaggatggcttatttatatcatacaatgcctgctttatttttctttttgcaatgacataggttagatatgcaataatttctgccaaaatttcttctgaagctatttccatttttcaattacatatcattcccaccccaaccacccaaacacatgaagaaataaaaattgccaattagtatttataattttgtcttaaaagaaggtatgttttctgtttattagaagaaatataagaaaataagacacattttgttctttaaataaaacttaagtgatcacataactacttattaaactttgtccttttgttacattttattgctttcttgttttcaattttgtcactatattagtcagttttcacaatgctataaataacttcccagaaactgggggatttataaatgaaagaggtttaattgactcagtttcacatggctggggaggtctcaggaaacttacaatcatggtggatggtgaaggggaagcaggcaacttctttacctggtgacagaaaagagtgaagaaggaactcccaatcacttataaaaccatcagatctagtaagaactcactcactgtcataagaagagcatgggggaagcctcccccatgatccagtcaccccgctccttggacaagtggggattataggtccctccctcaacacatggggattacaaatcgagatgagatttgggttggtacacacagccaaaccatatcagtcacctagaattctttaaggaaatctatttctaggtcagttttaaagtaagtacaatatatatacctatttttgtataattaaatatattagtttaacttttaacagtctattctagcattgcttaacctttttcattatcaactcctgtcaaaagaggattttaagatttttttctttctaatagaacccttataaatttgtacttccacagatatatttatgtatatatattatccatgctttatacataagaaaagtaaggttttcttgtctcccaaaacctgattttccacattggaaatgatctaccaccgttgagaatgcatgctctagccaaaagagagtcctctgtaacttccttatataccataaacatttccacataagcattgttctttcagcactcattacagtggcatcactttctaaaatgtctgtccatattactatatggggcaactcagggtatctctgagcttgtactcaatactcatcacttcttaagtaatgaaataagggaaaaataccatctccatgaattgcattttatgtgataatctgcttagcccaggccttcctatttatttgattatgcttacattttctgccaagttataacacaaagtattgtggtttgttttctgaataactattttaaatagtcttctctatgcttattgaatatgtgacattttgcttatcaggtgtttttataggtcctatatactaatccaagttttaattttcttttttctagtattctgttgggttcaatataaacatgcccatgcccttctctgaagagtcaagagtaatgtataccttaagcattgtccttctgtcacagggcttttcattatattacattgtctcacaaatcattttcttgtatcatttctagaaaaaaaattcttaactggaaactgaaaagaatgtgacagccagattggattctctgtgaaattctatacaattaaattttctggataacattcaagtaaaggattaacagaattgtaagtaaaacaagagcaataaaaatgcctctggctaatataataactatttaatgagagaaaaatatctcttaatttcccaatactatcaatcatttcatttgctgaatataagctcacgtttttcccaaacaatacccataaaattaaaggtgtttttctctattttacacacattgtcacaatttgacctaccttgataacatcacagggatagagccagatataggttccagttttattttatcatcactcattccttgagctagtttagtaattttcagctgtttcattaccttaatttgggatgtctccaaattggttgatttaaaaatgtatgttaggtattcattttgctgacaacaattcactgaagtaactgaggatcatgttttctaatgtcttgtccaacacagtaatttaaattaggaaaacagaattaattggaagaaacaacttatgtttctctatctactccctgggactgcattcaaagagctaagatgtacacaatgtgaaactgccttttgaattagaagttatgaactcagattctgctgtgtccttccttttccagctgccttccttcagatatactttcctagtaccttcctgtgtgctactatgtaaatagtaggtaactattttagaatcattcctcagcagcaggctttatgaaaagtgctgtcagtttgttttctttaattgtggtgtaaacagtactgctgcttaccttaatattaattatatacacacatttttagaagttacagatatataaaagggccaggtactttattaacatccttttttctttctggtaaaggtaaaataagccagattggagattaaaaagtgtaggaaacttcatttggatgccattcctttgttaattgttagcatgtaggcaataagaggaatatttcaatatcaattggccaagcagaaattttcctgagaataacagaatgttttcaatgacatgttatttatggagtgtaactgttccacaggagcagtctagtcagtagaattaaatgatactgtatactagaactggaatctgagataaaatagaagtggtaagtttacaggcacactctgtttcattgcacgtggctttattgtgcttcacggacgttgcattttttacaaattgaaggcttctgacaaagatgccttaagcaaatatattggcaccatttttccaacagcgtgtgctcatttcatgtctctgaggcacattttggtaattctcagaatatgacaaacttttaaattactactggatctgttatggtgatctatgattagtgatcttttaagttactattgtggttgtgttggggtgccgcagaacacaccatatgagagcaaatttaattaataaaggttctatgtatacatttttttgacacatggtccaagatgagatggtgtatgtgttctgatttctccacccactgaccattcccccatctttctcactttccttgagccttcctattctctgagacacagtgaaattaaaattaggccaattaataaccccactatgtatgggctctaagtgtttaagtgaaagagttgtgtgtctctgatttgaaattaaaagctagaaatgattaagcttagtgagaaaggtaggtcaaaagctgagaaagcttaaaaacttggcctcttgtgccagttagccacattgtgaacgcaatggaaaagatatttcataaattaaaagttctactccagtgcaaacacaaatcataggaaagtaaaacaacctgatgtgaagctgatgtgaagaaagtttgagtggtctggatagaagatcaaactagccacaacattcccgtaagccaaagcctaatctggagcaagaccttaactctcttcctttctctggagcttgagagagggaaggaagctgcagaagaaaagtctgaagctagtagaggtgggttcatgaaatttaagggaaaaataaaaagccatctccataacataaaagtgcaaggtgaagcagcaagtgcagatgcagaaggtgttgcagctagttatccagaaaatccagctaagatatttgtagagggtggctacgctaaaaaaacagatttccaatgtagataaaacagttttctattagaatatgccatctagaacttccgtaacttaaaacagagaggtcaatgcctagattcaaggtttcaaaggatgggctgactttcttgttaggtgctaagagctggtgactttaagttgaagccaatatttattgaccattctgaaaatcctagtgcacttaagaattctgttaaatttactctgtctgtgatcaataaatggaataacaatgcctaataaaagcatatatttatggaagcataaactatgtttacagcatagtttagcaagtattttaagcccatggttgagtcctactgctcaggaaaaaaaaaagacttctttctaaacattactgctcattgagaatgcacctggtcactcaagagttctgatggagatgtaaaaggacatcagtgttgttttcttgcctgttaacacaacttccactctgcagctcatggataaaggagtaaatttgaggttttcatcttattatataagaaataaatttcataagattatagctgtcattgatagttattcctctgatggatctgcgcaaagtgaactaaaaatcttatggaaatgattcaccattctagatgccaatagcaacatttttgattcatggaaggaggtaaaaatatcaacattaatagaagcttggaagaagttgatttcttccttcatgaatgactctgagaggttcaagagaggtttaagacttcagttggatgaaggaattgcagatgtgatagacatggtgagaactagaattagaggtggagcctgaagatgtgagtgaattgctgtaatcttatgataaacttgaacagttgaggagttgctttttatggaagagcaaagaaagtggtttcttgatatgatacctactcctaatgaagatgctgtgaacattgttgaaatagcaacagataatttagaatattttatatactttgcagcaaggattaagaagattgactccaattctgaaaaaaacttatttagctacaatgctatcaaacagcatcactagctacagaaaaaaatttaatgaaagcaagaagtattcaatgcagcacaattcattgttgtcttattttaagaaactgacacagccatcccaacttcagcaaccaccctcctaatcagtgagcagccaccgacagtgagacaagaccctctatctgtataaagattaagacttgctgaaggttcagatgattgacagtatttttttaagccataaaacactttaattaaggtatggacactgtttttcagacacaatgctaattgcagtatggagtatacttaatggagtatagtatagtgtaaaaataatatttatatgcactgggaaacctaaaaccttatgtgactcgctttgttgcaacatttgctgtattactgtggtctggaagagaactctcaatatgtctgaaatatgcttgtattaaaaatgtgtattgctttgagaaacagaaactctacaacctatctaccaagaatctttgcagataataaagaaagaagttattgacttatttcaaacttaaagtctgaggagtctaaatggagactgaagttacgtctaacatgacaagtgtgaaccactttgatttggtttgcccagaggaaacattactcctgctactttcataaagactgattgcttttgacagaaatctgtctgtgcagagttggatgagtatgatactgagaagtcataaaaccattagaaaagactgggctcagaggatctcctcataaaaatgttcacatagaaggaataagacagtgaaaaagaggctgtatttgctatatatccacgttttgaattatgacacacatagggaatatttccagagcttggtttcagaaatcccaatgaactaattcttctgagatatcataaactaaatagtgggaaagcaagccaaagaaatactgtctgatttatttattttgcagactgcacttagattttttaaaaaagagcctctcactttgattcttgtatgacttgaagaaaaagctatactgtataaaggtgtttgcaggtgggttctctggcaagcagacaatgaggcagagattagttgcaagagttttgttggggtatgctttgggggtcaacatttttggagggcaaaggacaagaccagaattggattcagggagaaagtcaaactactgtgcagggtcaactacagccttggccaacccaaggaaggagctgcagaattgcaattgcatgtcacagtttttctgagctggggtaaaatgtccagcattttacactcaggcatcagtcaggatatgggctacactgaaatgggtgtgactatgggcaagggaaccttctgtagataaggtcatctctgaagtggctagcagctgtacatccctctttactccttcatccctacatcactccaaaaagccaagacattcagctctaccttcaagggagatctgcttggcacacagtcttcataacaagcctctatcttggattggtttttttcttagagtataaaatccttgcttaacagaatatagcaaattttatacacatacacacatatattaaattattacaatatcattcattgttttcaaatgaaacagccagctacattattacctcaaaggtgaaaaagtctagggtttgatttttttgatccaaactaatatttgtcattttccacccctgtgcccagagacgtaactcatattttcctgttgaatttgtttcccaagtagaaacagaagtcttaaatatgatgaactttaggttttttcttttagttcttataaacacccagtatggcagttattattgtccatattttacagccaagaatatttcagaaaaacaaaaaataagttcattttcctttagctagcaaataagagtatttggatttgaatttagagtatgaatgtgccatctgtttgtaatttttgtgcaggtaggggatgctgctataactagtgtagcattattaattattctagctgcatgatagattggagtccagagatagaaagatgagctggacataatttagaattcactctgaattattttcatgatggggattaagggccatatcacacaaatacacacttgaaggttatcattacatagcccctcagactttacatatatttcattagaaaaataaaaatctaagttacagagaattgtcagtgggttccctcaatgtctcccttactctgtggcaagctagtctgacatgatatctaacagaaggaaaaacatacttcagataagtcatggaagtcataccatgaagtcatgagaattacagtatatagtgtgcccagagctgtgaattccactaattattttgaaacattgaaatattcatttcaaaataaatctataaaccatccaacatctgtacttatctttatcattctcctgctgctaaaattgaggaaaactccacttcctcctaggttctcaagggaacatatgacacttgagcttttgggactctgttgcctctctttctggcatttctacatccctctttactccatctattgccatcagttttcaaacctgctgaagaatttatcattacaaaataaagagaaatgagaaagaaaatataattgcttcctactatgtctgttttcctacaatctcttcacatcccaagattctatgtgagggcagtgggtgggggaagaaaaggacaacatatatatccattgcactcatttattaatgagttattttgttatttagtcatgcaaatcatgcactatacaaaacatacactatgtttcctaatactgtttacttaattactcttaaaaagtcataattagttctttaaaatgtaaaactaaaatatgacaaatgatgccatctttgctattgagatggtttggctgtgttctcacccaaatctcatcttgaattgtagctcccctaattcccatgtgttgtgggtgggacctggtgggagataactgaatcatgggggcggtttcctccatactgttctcttggtagtgaataagtctcatgaggtctggtctgatggttttataagaggtttcccctttgcttggctctcattctctcttgcctgctgccatgtaagacgtgccttttactttctgccatgattgtgaggcctccccagccatgtggaactgtgagttcaataaacctattttttctttataaattaccctgtctcaggtatgtctttatcagcagcgtgaaaatgggctaatacatctatattcagttactaaatgtgttctgtgaatgaagttggatgttgaatgcagatgctaatgtactgccacatgccagttagacacaattatgtatgtatggagatatatataataaagggtacttgtttaggaatattttacaaaagcatggcctgtcagtgtgcaccatacatttcagagacatgatgaaaaaacattaccactagagtgtcacactacaaatgtgattttttgaattctctataaaaatgtcaatttcccaagcttagcatatatgtgtgtctaaatgtaatggcaagcttcataaatgatgagcatgccaatatacgaagatttggatgcaattatttactctaaaacttcatcaatattatgtggttgcaggtaacttttaaataggcccttttggatctcacatgaattgaaataggaaaaaaatctatttaaagaagtcctgaagtagacgtatatgcttaatattaaacattgtttgaaattgaagagtctggcttaacacactaaattaagaaagaagaaagaaagcaagaaagttggatgttgaatgcagatgccaatgcagtgccacataccagttagatagcatgtggcaagttctaatgggcacaaaatgtgccttgttcacattaatgctttagtgtagcactgaatttgcctctcagtaaatgttaactaaatttaaaaaatagtattattttccccaaatacatcaattcataacattacaaaataattatgctataagtttgatttgacttaaccatacatgttttcatccatcaattcattcatttattcacccacatttattgttgactttaagctgaacaacattttcagggctggggctctaactaaggacaagagtaatgtgttctttgatcttatgtcacttgaaccaaggtgaaaaagtagatattaaaaaataattgccttttaaaaattattacagtgataaacctaagtaataaagtaaatatgcattgcataataagagcatacagcaggacttttaacccggcctcctgaaaattacattctaatgggaaagacaaatgtcaaccaaaatattaagttacgaaaataaacaacttcatattttaatggacattatgaaaaagtaaagtgaactatgagagcacataaatataggtacttaaatccaatattgtgggttcaaaaaggaaatgacattcaacagcatccagaactcttaaactttagttttcacactgtcaggaagtttggaatcccaacggtgactttcacattacttgtattaaataaaagtcatgacaaaatgattacatttttcccattagtttacaatatttgtaaatacaggaaatgacaatagatacagtacctcttgatgttagtaacattcttgagattatttgatattagtaacattcttgagattatttttagtaattaagatagaaaaaaaatgttttctatataatggcataatgacttagattcagggatgactgaagaatcattctcaagttgaatgtcaaactggggaggctctgatggcacgaagcagctttctataacaatttcccatggatgaaatattgccagacatttttgtaacgtcttgggtgatggtaaattctctcttttaagttttagggaatcctattaattaggactactctctccatttcatagctaaggaaactgagtttcatatggattagatcatttgcccaagtcaatagttactaagtgatgcagctagaatttgaatgcagacaacctaaataggaatatgctatatttgcaggcagtcaaaaatgctgtaaagaaaatttaatgttggtaaagggaaagggggtatacttgtttctggaggacagggagagtgctattgaaatggggtactcagtgaagtcatccttgcaaaagatgtctttttgaatgaaagagtgaatcacacagagagttagagaaagagtgctccaggcagaggtaacaacaagtacaaaatccatttgaaggtttggtaagcgtagctgtgttcaagaacagcaagaagcccagtgtggctggagtggagtgatgcaaatgatgttggagagagcaggaggagccaagtcatgtggagatatgaaggctatgaaaaaggagtttggattctgttctaacacaatgagcatccactgaaatgtctgagtggcaaaatggtgtcatctaatttgcatttttaaaatatcactcttgctgtagtgcagaaattgactgtaagaggggtagcacaggtcaaaaagtaagatactatttacataatctaggggaaaaatgattgtggtttagaataggtgaggagtacttgcctttggaatatgtttcagacagatttactgataatgcaagaatcagaagtggtcctaggaagcagatacttaagatgagattttggaatttgctaatttgctagccaaatggcatgcttactgtacaggagttcagagtaagtcatgattcatttgaagccttcacctgagatgaactgatatggtatatgggggaatggggagcctggtttaatgccatatctgtataatttcagatttatcggtgaacattaattcataaaacttacagagttgattggttgctaaatataacaaaggtgttgaaaaagaataaatgaagctcagaaccagcaatatcaattcagaggtaaagagtaaaaaccaatgacctccattagcacgtttaaagaagctccatatccacagacaatgacagactttactcaaaatcatgctcaagatgtaattacaacctgctctctctctctctctttctctttctttcttttttttcgagacagggtctcactcccatttcccaggctggagtgcagtggcacaaccacagctcactgcagctttgactttcctagctcaggtgatcctctcacctcctgaatagctgggactacaggtatgcaccaacatgcctggctaatttttgtatttttttgtacagacagagatttgccatgttgctcaggctggtctcaaactcttaggctcaagcaatccacctgcctcagcctcccaaagtggtgggattacaggtgagccactacccctggtctcaagacataattacaaggaaagatgcaatcaactccctgacaagtcttccacaccagtattggtagggaaggagagctggtctgggcacatgtggctacaaacacttcaaaaaaacatactgattctctggaacttctagactgaaaacttcactttcttttcatttttagatgagaacagtatccctcgcctggagatcaggtaatgacttcatctgaattagataccttaccatcttgtaagcaagatgatagatgtcctctgtacctatgtccctgcattgcttttgcaccaataactaaagtcaagttgcagcatgttctaactgtccctgctatgagtagaaaaggattattcccaaaaagaacagcaggatatgccttatagtattggcagcaccaggaggacatgactgaggatagatcttgattatgttggaaggggttgaagggagaaaagtacatcttaccaagagtttagtggtatggagatactttgtcataattgtggccaggacacctggagttgattctaaggtactgctggattattccccaaaggttgtgaaaaacagtggcctataataaacaaggtgtaggtagtgaaagtgcctggacagggatttgaagttaaaggtatatagaagtgggcattttagcatggatttcttatgtatgaccagagaaaccatctattagttttgttcctcaggagagcctaggtagcactcccaattctgaagcaatatagaaaggtgcaacaagaggtgctctggtatcattgaaaagttcagtgatggctctcctcaccaggccagagtagagggtagtgaatgttgctatgaaacttgtgttccttagtgtcaatgtgagtggaagaattctggattcagaatccaggtggaaatactccaatatcagaggcagatggatgaaatgtatcatagcaatcagcaaaaaacaacgtcaaataagctgctacgaagtgcaaagatctataaggatggctatccaaccacggtgttcccaaagcaaatacagaaaggcagccaagaaggctattgctggatttatataatctaaaaacatcaaaatcaggtaaactaaagccgcatcattgtgttctttcctgtgattaatacacatttgaagtatgagttgcttttttattgctgcagtgatttggccaatattaatagctgaggacactgactattctgactttgtccagaaaattgcacataacatcaattccaaccaagaagttcatctcatggcaaagttaggtgcaatcatatgcataggaccactggatctgttggcactaatatacagtaccacccagcagtgctgacctagtagaatactggaaaagcctcttaaagatagagctaaggatgaatttgggaatgaaatttttcagggccacagaaggaatgaccattgtatggtacatttttcttgataagaagactagatggaaatgacaaatcaagggttcagggtgggaatggcctctctcatcatcatcttgactaacccatttgggaaaggcatactttcgtccttgcaaagctaggctctgctgcactagagatcctggttttctgaagaccggggtgatgttttcactgagatgacatagtaagggtcccattaaaccaatatttatggttagtcagtagaaattattggctctttatgccaacaaatcacaaagtacagaaagaaatcactacacctatgaaaatagctaaaatttgatgaaaaagatgagagagcttgctctgctaggtatcaagactgtatgtaaaatcactataattgagacagtgtgctattgctgcaagactagactaataaaccaacacaatagaatagagagcccagaaacaaaccctcatacacatgtatatgggatttatgataatatgtattgcgagtcagtgggaaatatatatatttatatagaagaaaacaaattatactcccacctcactccacacacaaaaatcatttcagatgataaacctattacgaataacaagacaataaatctttaaaaagcaggtccttcatgacctgaggaagtaggctattttttaagcaaggtcaaaagaatagtaacacttacaaaatgatggataaatttgataatcttaaaatttaaatctgtgtgtcaaaagatatcttgcaggaagtgaaatggaagctcgagaatgggagaaatgtttgaaacatatataacaaaggaggggctcatttctataataatcaaagaactcccacagataaaaaagaacattcaagaagaaaacacatttactccaacagataaataagaaactcaaataggcatttcggaaaagacgaaattcaaaatagtaagtaaatatatgaaaagattctcaatgccattagcaaaatgctaatcacgatcataatgcgatatcactgaaaccgtaacaaggtggctcaaattagaaagactgacataccaagcacacagacaggaaccatgaccaactctcatatacaactcttggcatagttactatggaaaacaatttcgcatttccaacaaaattgaatagacacatgttcataacatagagaaactcaggcacatgagcgccaggagaaatgatataaacatattcacagcagcactgaagataacatcctcaaactggagagctctcaaacactcatcaacatgagaatgtgaaaataaattgtggcatagccacaaacagcaaataaatgaatgaacaggtagaaatgtggctgaatagtaaaaagttaaatatgaatgaaagaagacagatactaatgcacacacactctaaaattctgtttacaggcttcgaaaaaagacaaaactaaactataatgtttataaatgcttacttagatggtaaatgtgcaacaaaaaaacccaggaaattaacatagtggttaactctaggtggaggaaagcaattgcgcctgagaaggagcatgaagaaagattttctggtgatgcattctatacctgatttggacttacatttatgtttactgtataataatatactaaactgtacatttatctttaaatcacttttgtgtattacattttttttcttaaagtttaaaggacaagagttggtcttaataaaaatctccggatatagctggaattctttctgtaaaaccaagttggttgccaagcttattcctcaggtaggcaataaagtccacgtaagtaattgtagtgagttataatatttgtagagaaggaaaactgaactgaactaaagtgaataggtcatgaattttcatcagtctataaaacagaagtgcaatttgtataaagtaggatctcataaataagtaatgtagcattaaaatatatagctagatagatgtagcaggggtttgtgaggcaaaattacttggtattgcttcttggatatacattaaataatttaaatggggaaatggaaaacacaatttcaaatacatgaccaaataggctgatagcatgtctgttatacttttcttccatgtagtttttacgcctgggaaatgccttcattatctttgcctgtcccatgagtgggtaaagagatgtgctattttttccagtaccaactataaatttcaattgttctttgcattcacactgctgtgtgtggtggggggtgggggtgataatcacttttttttttttatttcaacttttatttagattcatgcatggatggtacatgtgtaggtttcatagaagggcatatcatgtaatgctgatatctggggtactaataattctattgcccatgtagtgagcatagtacccaatggttgtttttttcagttttcaacccttgtgcccctcccccagtctcttctctagtagtccctagtgtttattgttcccaactttatgtccatgtgtacccagtgtttcagtcccacttacatctgagaataggtggtattcggttttctgtccctgcattaatgtacttaaaataatggtctccagctgtattcatgttgctgcaaatgacatgatttcattttttatgactgtttagtactccatgctatatatgtaccatattttctttatcaaatccaccattgttgggcatctaggttaattccataagtttgcgattgtaggtagtgctgtcatgaaaatacaagtgcatgtgtctttttggtagaatgatgtattttcctttgggtatatacccagctataagaatgttggttcaagtggtagttctgtttttagttcagccactgcagaaagcagtttggagatatccacatttacatttccaccaacagtgtatatgcattcccttttttccacacctttgcaaacatctgttatcttttgactttttaataatagtcattttgactggtgtgagatggtatctcattctggttttgatatgcatttcttgatgatttatgatgtggatcattttttcatttgtttgttggctgcttgtatgtcttgagaagtgtctgctcatatcttttgccaaatttttaatggccttatttcttttttgtttgttgaattattttaagttctttatagaatcaggatattagacatctaaaagctgcatagttagcaaatattttctcccattctgtaggttgtttactctgttgatattttattttgctttgcagaagctccttagtttaattacgtcccacttatcaatttttgtttttgtggcaattgtttccaagacttagtcataacttctttgccaaggctgatgtccagaatgatatttcctaggttttcttccaggatttttatagttttgcatcttacataagtgattagtgcatcttgacatactttttatacatactgaaagggaggagtgcagttttattcttttgcatatggatagccagttatcccaacatttattgaataggaagtccttttctgattgcttatttttgttgactttataatcaaatggtttaattctggggtctccattctgttccgttaacctatgtgtctgtctatgtgtagcctatactactgtaggcttgtagtatagtttgaagtaggataatgtgatgcctttggttttgttctttctgcttaagatcgctttggctattcaggttcttttttgtttccatgtaagtttcagaacagttttttttttttctaattcagttaaatggtactggtagtttgataggagtagcattgcatctacagattgctgtgggcagtatggtcattttaatgatattaactcttccaatccatgagcatagaatgcttttccatttgtttgtgccatctatgatttctttcagcagtgttttgtaggtctccttgtagcaatcttccacttccaaatttagatgcattcctaggtattttattttcacttgtgactattgtaaatgtaattgcacacttgatttggctctcagcttgactgttatttgtgcataaaaatgccactgattttttttaccttgatttttgtatcctaaaactttactgaagttaccagtttcagtagccttttaatggagtctttagggttttctaggtatagaataataatttcagtgaggagagatattttgacttcttctgttcctacttggatgtcttttatttctttctttgcctgatttctctaactaagatttctggtaatatgttaaataggaggggttagagtaggcatccttctcttgttccagttctcaaggtgaatgctttcagcattttcatgttcagtatgatgttggctgtggatctgccatagatggatctgattattttgaagtattttctttcaatgcctagtttcttgtgggtttttatcatgaggaaatattggattttatcaaaagctttttctgcatctattgtgatgattttttttttttttgagacggagtctcgctctgtcacccaggctggcatgcaatggcgcaaccttggctcactgcagtctctgcctcctgggttcaaacaattctcctgcctcagcctcccaagtagcttgcactacaagcacccgccaccaagcctggctaatttttgtctttttagtagagatagggtttcaccatatttaccaggctggtctcaaactcctgaccttgtgatccaccctcctcggcctcccaaagtgctgggattacaggtgtgagccatggtgcccagctttgtcattttgagatactttttagtatgctgtgaaattcagttaggtagtattttgttgaagatttttatgtctctgttcctcagtggtatgggcctgtagttttccattttaactgtgcatttaccagattttagtatcagaatgctggcctcacagagtgcgttagggtggagtccctcctactcgaagttttggaatagtttcagtaggactggtgccagctcttctctgtatgtctggtagaatttggctgtgaatccatcctttcaagggcattttttgatcggtagatttttcattactaatttaatttcaaaactcattatttttctgttcaagcttttgatttcttcttgattcaatcatgggagcttgtgtgtttccaggaatttatccatttcatctacattttctagtttgtgtgcatagatgtgttcataatagcatctgaggatcttttgtatttctgtgaggttaattgtaatgtcatcttttgtcatttctgcttgttcttaattggatttcctctctttttatttgttaatctagctataggtctataaatcttgttcatcttttcgaagaaccaacttttggtttcattgatcctttatatagattttggggcctcaatttaattcagttctttctgattctagttatttgttctcttttgctagacataaggggttttgtttgtttgtttgtttgtttttccctagatcttccaggcatgatgatagagtattaatgtgagttatttctatatttttgatgtatgtatttagcactatagactttcctcttaatgctacttttgctgcatcgctgagattctggtgttgtaacactgttttttaaatcaactgtattgatatggtttggctgtgtccccaccaaaatctcatcttgattgtagttcccataatccctacatgtcatgggagggacctggttggaggtaattgaatcatgggagcagttacttctatactgttctcgtgatagtaattgagttctcaaaagatctgatgttttacaagcattttttctctcccttcactctgcatttctctgctcctgctatcatgtgaagaaggatgtgtgtgcttccccttccaccatgatcgtaagtttcctgaggcttccccagacatgctgaactgtgagtcaattaaacctctttcctttgtaagtatccccgtctcgagtatgtctttattagcaatgtgagaacagactagtacagtacattggtaccacagaaagtagggttgctgtaaagatgcctgaaaatgtggaggcaaatttggaagtgggtaacaggcagaggctggaacagtttggggggctcagaagaagatctaaaaatgtgagaaagtttggaacttcctaaacacttggaaggctaggaagacagaaagaagtgggaaactttggaactctctagagacttgttgaacggctttgaccaaaatgctggtagtgatttgtacaatgaagtccagctgatgtggtctcagctgaagatggggaactcgttgggaaatagagtaaatgtcgctcctgctatgcaaagagactagaagcattttgcccctaccccagatacctgtggaactttaaacttgagagagattatttaaggtatcttgtggaaatttctaagtgccaaagggttcaagagaaaacagagcattaaagtctggaaaatttgcagcctgatgatgtgatagaaaataaaaactcattttctggggagaaattcaagcctgctgcagaaatttgcatagataacaaggaaccaaatgctaatcaccaagacattggggaaaatgtctccagggcatatcagagacctgcacagcatcctttcccatcataggcccagaggactaggagagaaatggttttatgggtcaggtccagggcccactatgcagcctcagtacatagttccccatgttctgcctgcttcagctccagccgtggctaaaaggggccaatgtataggtccaggtgttgcttcagagggcacaagccctaagccttggccgcttacatgtggtgttggtcctgtgggtgcacagaagtcaagaattgaggtttggaaacctctgcctagatttcagaggaaatatggaaatgcctggatgtccaggcaggagtttgctatagaagtggtgccctcatggagaacctctgctacggtagtgcagaaaggaaacatgtggtcagagcccccacacagagtccccactggggcactgcctagtgaagctgttagaagagggccaccatcctccagactccagaatggtggatccaccaacaccttgtaccatgtgcctagaaaagccgcaggcactcaatggcagcccatgaaagcagttaggaggggggctgtacccgccaaaaccaaagggttgaagcttcccacggctatgggagtgtcactcttgcatcagcatgacttgtatgtgagacatggaatcaaaggaggtcattttgaaactttaaggtttaatgactgccctcttggattttggacttgcattgggcctttagcccctttgtcttggccaatttctctcatttagaatgcatgtgtttatcctacgcctgtaccctcattgtatctaggaagtagtaacttttaattctacaggctattaggtggaagaaacttgccttgtctcagatgagacttaggacttggacttttgggttaatgctgcaatgacttaagactttgggggactgttggaagggcataattgtgttttgaaatgtgaggacatgaggtttgggaggggtcaggggcagaatgatatggtttagctgtgtccccacccaaatctcaccttgaattttagttcccataatccgcatgtgttgtgggaggaacccagtgggaggtaattgaatcatgagggcaattacctccatgctgttctcatgatactacgttttcacaagattgatggttttctaaggagcttttccccgcttcgctctgaacctctcctgcccccatgtgaagaaggacacatttgcttcctcttccaccataattgcaagattcttgaggccttccaaactatgtggaactgtgagttaattaaacctctttcctttataaattccccagtctaaggtgtgtctttattagcagtgtgagaacagactagtacatgtaagtatactcttacacatactgaaattctaaaagtggacatatatccaatatcaaagctttttatttatttgtcaagagaacttatttatgtgtttgtatgcttgtgaggtaagacaaatatgtatgtttagatgctgacatatactttaccggttctctttttacatttaggaatcttcattacaaaactttacttttagataattttatgtcattaaatttagtttcatttcatgtatgtacatacattatgcaagggctaagccaagcgttgggctatgtagtgaaatttctaacatcaatctctactttcaagatgtttagataaatagacaacataaatatactctagcaattactatcaaaatttgtacacagtattacatgagaccatgaatagaaaacaccgagggtataggaaagttcacaaaagattttctggaaaagattatagtggctaaattttcaagtatctgagttatctttaaaaaatggagaaaaagaaaatcaaggtgggggtataaacagatgcaaagagacatatattagcaattgtgagcaagtgagtatggctagagataaagttgtcaaagtaatagtgtgaggtgggtactgtgttttgtttgttctgtgggtaataataaccatattgtgtacttaagttatttgttagttagagacataattccagaatttacatcacagataattataaagtgtcaagaccagtatcaggataactaactcacaggctgtagcaatagttcaagtgagaaataataagagcctgattatggttgttatgagagagagaatgtgagaaaaatttgtaacatgtaaaatgatcaatattggtgattacttggatatggagagtgagagagaaagaggagacttagatggctccttagcatttggcttggggaatagttaattgaggtacagaattcagaaggagccctttctggggaagacgaaaataagacttcaatcttaaaaatgttgaaatttagatgctttctggaaattcaagtggatattttacagatatatgtctatttgaggctgtagcttaaaggagtagaaggaaaataagcatctcaatgtaagtaaagctgtcggctttaatgtaattgcaattgataaaaaaggaatacatagagtcaaaagggcaacttagatgatactttcaaaatccaaagtttaaggagcaaacagataaggggaagacagaattagatgtgcttaaacatgaaaactagcagcaagcaggtagtagaatcttaagaaaaaagagagacagagagagatcctatagcaatagagcagtaaagtgacttagataaagataacatttaaaagcacagtggtcatttgtgaccataaagtggacacagatatcattcattgtatagctgggatttcacaactataaatatttacacatacacacacacacaataatgtgtatttttctaatagctgatattaagcctaaacattgctaaaggggtaggccctaaataaatattgtaaaaatatattcttaaaattttctaatctatttatgagctgctaattgaatatctgaaacatgaccacatttcaaaaatagtcacagacattaggtagatttctattgtaaatattattatgtagcacatttatattgacataaccaatttttcaaattgtgtgggcttttttctttatcagaatgagttacagggtttgcattatatagtttggcttaaaaagagaactcataaaattccccacttgcagcccacttaaaaaagaattattacagttttaggcactgttgagtgtcatactgagctacaaaaaataagaaatcaccataatgctctccaccttcattttagttttagaaccccacacagggagacaactatagtaatcagagttaggccactgaggttcagatttattttgtttaatattaaattgtatagttgaaggaaacatcatttttttaatgactgtatcactacccttccaaacactgtagtttactaatgattttaaaacttctttaagtgcttaagacagaaacattcctacaatatcttagctaagatttagcatgcaggtctcatactgggaatacatttgtgttttaagttaaataaattcagcctcttatttagaactggaagaacatgttgtagacttatggttctatttttgttacctagacctcaaagaagtcagttcagtagaaaaatttatacaaggtattacatggaagtttactgggaatcagcttactctatattatacaatgctgagaacattgtttaatctttgtttaaacattgtttaacaggcagtatagtttccaagtgtgccttctctaatgcatttgtgcaagcatttatgcccagggttgctatgaaaaacagagataaataatttagtccttaaacttgagaattctgaccttagcagactcctcaatgagatactcctacaaaggccagacacctctgatattagctgaaagccttcctacctccacttccctcccccctcaacctccatccacccatgtctcacatacagaaatgcactaaagcatatagtgtgataagtgtgctgaagtaaaaggccacctctttttcttttatgctgaattatgttaataagtacaaagaagtttttctcatgatcatgtatcttagacagaatttactgaaatagatctttatcttctcactttctaacccagactgatgattgaattcacagaacattagttgagaaaacaaatgaaaatgacagaaaccatgttgaactatgcatcatgttctcctacttctgatgacatcaggtttataatgagaccagattcatctgtctgactgttacacattagcataaattattcccaggaaatccttcaattctcttttaggaataaataagattctgagaggcacatccaagtccattgttgggattatgccatttttaattgatatataatatatgtacatatttatggggtacatgtgatattttgctggaatgtgtaaaaatcaaatcagggaatttggggtgtccatcacttagagtatttaccatttctgtgtgtggacattccaagttctctcttcaagccacttgaaaatatacaacacattgctgctaaccacagttgctgtattagtctgtcctaatgttgctaaaaaaggcatacctgagactggataatttataaaagaaagaggtttaattgactcacagttccacatggctggggaagcctcgcaatcatggcagaaggtgaatgaggagcaaagtcacaccttacatgatggcaggcaggagagagcttgtgcaggggatctcccatttataaaaccatcagatcttgagagacttattcactaccatgagaacagtgtggggaaaactgcccccatgattcaattatcttcacctggcccctcccttgacacatggggattataattcaaggtgagattttcgatgaggacacagccaaaccatatcatcccatccccagcccctcccaaatcccatgtcctcacatttcaaaaccaatcatgccttccaaaagccacccaaaatcttaactcatttcagcattaactcaacagttgaagtccgaagtcttatctcagacacagctagttccttccgtctatgagcctgtaaaatcaaaagtgagttagttacttcctagatacactggggatacaggcattgggtaaatatacccattccaaatgagagaaattggccaaaacaaaagggctacaggccccacgcaagtccaaaatccaatggggaagtcaaatcatgaagctccaaaatgatctcctttgactccatgtgtcacatccaggtcatgctgatgctaaagatgggcttccacagctttgggcagctccacccctgtgactttgaagggtaaagctcccactcctggttgttttcatgggctcatgggctggtgttgagtgtctgcgacttgccaggcccaaagtgcaagctgtcagtggattactattcttggggctggaggacagtgaccctcttttcacagctccactaggcagtgtcccagtggggactctgtgtgggggctcccacccacatttcccttctgcactaccctggcagaggttctccatgagggctctgcccctgcagcataactctgcctggacatccaggcatttccatacatcctctgaaatctaggcagaggttcccaaaccttaattattgacttctgtgcacctgcacgatcaacaccatgtggaagccgccaagacttggggcttgtaacctctgaagccctggcctgagctataccttggccccttttagccatggctagagtggctgggatacagggcactaagtcatgaggatacacacagcagaggggtcctggacccagcccaggaaaccattttttcctcctaggcctctgggcctgtgattggagggcctgccatgaatgtctctgagataccctggagacatttcccccattgtcttggtgattagcatttggctcctccttacttatgcaaatttccactgctagtttgaatttctcctcagaaaatgaggttttctttactactgcctcatcaggctgcaaatttctccaacttttatgctctgtttcctcttgagcactttgccacttagaagtttcttctgctagatatcctgaatcatctctttcaagttcaaagttacacagattcctagggcaggggcaaaatgccaccagtctcttgcatagcaagagtgaccttaactccagttcccaacaagtttctcatctccatctaagatcacctcagcctagactttattgtccatatcactatcagcattttggtcaaagtcatttaataattctctatgaagttccaaacattccctcatcttcctgccttttgagccctccaagtctctaggaagtaccaaactttcccacattttcctattttcttctgagccctccaaactgttccaacccaggcctgttacccagttccaaagttgcttccatatttttgggtctctttccagcagcaccacactctactggtacccattcactgtattagactgttttcatgctgctaataaacacatacctgagactgggtaatttatcaaggaaagaagtctaattgactcacagtttcacatggctcaggaggcctgctttcatggcagaaggcaaatgaggagcaaagtcctggcttacatggtggtaggaaagacagcgtatgcaggggaactcccatttataaaaccatcacatcttgtgagacttactcactatcccaagaacagcatgagaaagacctgccctgatgattcagtcacctcccacctggtcctttccacgacgtgtgggaattatgggagctacagttcgagatttgggtggggatacaaccaaaccatatcggtcatatccccaaaccatatggttggggatacaaccaaaccatatctgctatctaacattagaacatatttctttctttctttctttctttttttttttttagaccaagttttgctcttgttgcccaggctggagtgcagtggtgcaatctcaactcactgcaacctctgcctcctgggttcaagctattctcctgcctcagccttcctgggtagctgggattacagagatgtgccaccatgcccagctaattttatattttcagtagagacaggatttctccatgttggtcaggctagtctcaaactcccgacctcagatgatccacccgcctcggcctcccaaaatgctgggattacaggcatgagccaccacacctggccagaacttatttcttctaacagtatgtttgtaacaactttcttcatcagccccatcctccaccaccaccactcttctcagcctctggtatctatcagtctactctctatttccatgagaacaactttttcagctccagcctatgagtgaggacatgtgatatttgtctttctattcttgatttattttacttaacataataacctccatttccattcatattgctacaaatgaaaatgattttcattatgccacttttaaacatgaacatttgacaagaaattgacttatttattattgttatgtaaagtaactagtttaggctaaattgggtctactgttgggagtatgcacaataacagtaatacaataataattatgcataaccccaacaacagacccagctttaccctatttatcttatataacaataagtaaatacataatacataaaagaattttatatttttcctctaacacataatatttctttatctcccttttcctttttctctctttcttacatatacacatgcgcttgtgcatggcacaggttagtataaaccagaatcaatggcagagctcactaaaacacagatttctggccccaacactagggtttctgattcaatctctgtggtatagagtatagcagtctgcatttctaaggtgtttctattggtgctgatgctgatgctgatgctgcttttccaggaacaacactttgatagccacctaacgcatgtttgtattttttcagttcagatacgcatgagcaagtcacaggaagcatggtcattggagaatcctgtatagtagagtggttaagaccaaacatttgaaagtaattcaaatatgtacaatggaaagcatttagaatagttcgtggcacattgtaagaattcaaaaattgatagtcattattactgattttttactagagctgtcagtctatccaatatgcttctttcaatgcaagctccacatatcccactagctggacttattttaagatgaataaacaaaaatacaaaaatcaggatcgcaaccatgagctctattttgataataacaaatatctttcatttcctttaaatttctaaaatatcctacaaatgtgactatatgcatatatatgttcatgtactaaatgttgatttgtacatttgttattatcaaagaccaagctttggctaacacacttaaaaaggataaacgctgtttataatctgactgactatgattgtttgtagtgatgcagtagaagaaaatcatttatcaacttaagattttatagtttcttaagaacagtacttccattaaaatgttctctaaatatggtaatattaggcaaatgcaagagtgcaactaccgtatttcgaaaaatcataaacaattgtttgcatttagttcatagtgttgtaaaaaatattactttctataatatacgtagccatactttataaattatttagtatttaacataattataataaaaattaagtgcatattagcttcattccttattttaaacctgtacatatattatgtgtatgtattaatccttcaaatcactacttgagatgaattctattattatctccattttgcgatagcgaaatccagtcccagagaagctaaattagttatccaagattgcattagttattttggcaagtcaaatttgaactcaggtagttttattccatggcccatattttaagctgttcattaagttctccatcttgttgggatgctgggtctggattcatggagtcacgtgatctagtgacaggatgaaccaagtgaccagggagtggtcgtctcattaaagtatgtaaggagcataagaggtgagggttgttaggtaagatgagaagtccgggatccctgtgtggtgagtctagaagtcacagtccagtataaaacaggcttttaaaggtaagtggctggaaagctggacactgatttagtagactggcttagagtcagtctatctaaaggctgaatggaccttcacagaagttatatcatgctctgctgttgtatattcccaaatgcctattcctttgagacttgaggggtccaggaccaggcctgcagatttgatcagaatatgactgcatttgggggcttctactggcatctgctcccccaaagacttgggatcatctgagagttctgcagttgagtatgaggcctctagtaagaggcctctcatatctgagacccattctaaagatcaattatttgcatgcttgtggtccacagtcaagatatgcatacaaatcctctagattctatctcctgtgaaatactctcaaggatactaggcaaaatattacactaagtcttcatatcattcactatttcattaggccccatctgaactcaatgtatttttaatcatttttccagaactcctttaaacagctcttccattattgtcagaatactgacttagagtcctcaaattgcttcttcagctggattatatttcatattacatttttttggctggtatttttatttccttttttttttaaatttccaacaaagatttcactaatacattgaaaagaaccaagaataatctgcttttctcatgaaccctaacctggccacctcagtctattataatgtctctttttccttgcagtaaagaatttatagcacccatttgacacttgacacagagtatatacttactgtatttactaggttttgagtatatcttttcatacatattgttacagttttcaattctaaatgcacaaggtataatatgataccttgtgaataaaaagataaacattaaaaattgttgattggtaggttattttttaatatgctggataaaactttttgctatgtataatccataaatttgcttcaaaagtattccttagttattatttgttactacaacactacctttaaaaactaaatgaggccgggtgtggtggctcaggcctgtaatcccagcactttgggaggccaaggcgggcagatcacctgaggtcagaagttcaagatcagcctggccaacatggcacaaacctgtctctactaaaagtacaaaaatttgctgggcatggtggaggttgcctgtaatcccagcgactcaggaggctgaagcaggtgaagtttgaacctgggcggcagaggttgcagtgagccgaggtcactccattgcactccatccagcctgggtgacaagagtgagattctgtctcaaaaaaaaaaaaaaaaaaaaaaaaacaaaaaacaactaaatgaaaactcccttcagcattttaattcaaatattggattattcatattaaaatatcaatagaatataaacacaaagttgataactcaaattcagtatagtaattaacaatatgtatcttggttttaagtcttaatagtttttgatgacaattaaaattaaattttacaagcagagcatgagtaatttagtgaaattaatatatgatataattatcattaggtagcaaccattatgagcatcaaaattccatcctataaacattacactgtgcagaatcagttagatgcagcctgccttggatgtcttcctcttcctttttgctttcaacatcgttttagtttttatgaaaacaagttattgcctaaagaccaggctaaggtccatatttcaattttaaaaactgaaataaattatagaggccatttcttatcaaatttaagaaccaggagacaacaacaaggttaacacaataattcaagaacaaagaatcactaggaaaagcgggaaaaaaaaaataagaaaaaaaggaaaagaaatttaactaaaaactaatcatcatgttgatgtctacttgtgtgtttttagttatatattccatctgggctttatctctccaagctaaataaattaagaaaatgggaaagatcatttttgtaaataatttcaatgcttgtttgtttttaactgaatagttaatatatatatggctaagtgaagtttttcagttttcagcaatgtggcattttaaactgacaactgtaatataacttaattatcattaataaagacgattacattagttcaagcctcatatgcctggtttattacaattgcctcctacttctgccttctggatttagaatctcccatttcaatatatcaggagtaatttttataaaatacaaatcagatgttgccatacctcagaccctttagtggctcccccgtcaccttctacaacatggtatagaaaagtgtttatgacatggtacgtcttattcattgtaactatgctatgtcacactctgatttctctgtgcctttacttatacaactaactttccctaacagattccaacttctctcaacttctctcttacctgtgttcttccttcttgagtcaacttcagcatttctcctttgatgataatttttgcacatgcccctgttatagactttattaccttgttttcttggtgtagccaaacttgtcagtgtcctatgcatgtccctcagagcatttggtatgctttggccaacttccacctcctggtattgtcactggatcctaagggtgttgcttttccagccagaaacctctgcgggtggtggcgcctttgcccaagttttgctcggactagctgtgtttgtatcacccactccacctggcaggctgtgcttggctcatgctactgggctaaatccgacactttgccagggcaagccaggttcagagcagcgatgggtgcatgagcgagcaagtgcagggtcttgtcactgtgcatagccacgcacgctagctgctttggcgggacgggtagctccagccgccctctcccagcaaaccttagattgaatcagatacagggcaagagccttctgctgtgagcacccgcgtctggatgaggggctccctgaagagccgcaactcttctctcctttttgttgctcgccacatggtgaggggggtggcagctaaacaaggttttagccctgtttgtgttaccgctctttcattcctgccatttggtgggtcccgagtttttggcccacatccaggaagaatgaggtacgcgcacagctggagagttaaggtggagaggaactttacaaagctacagaacagctctcaagagaccgaagtgtgtagctcctatccataggcaggttatccccataagtgtccagctctcagcagagagaagacccggaataggtagttcctttctgcagaaggtggtcccaggagacacgaagaggaaatctcctccctgcagctggtattcttgatgtctgtgtgaggctggctggctccagggtttttttgggctcagaaaggaggaagtacatgttgattggtccacgggtggccatgggcaggcccggtaaaagcaccgtaagttttcactctgggccacggactccactggaactgatgggctggtccccaggcttcaggccatccctggcttgaaggtggggcttcaccagggacaccccactttccacccaggagcctgtcttctgctgccatcaatcatgttgttcatggtgcccaggctgtttatgaggagaagtgcctgcaggcccacagtgagcagccctctgtcccctcttggcctccctcctatgttcattggcgcccaaagttcacaggaggctgaggtggcagggggctggcatgtcagcaccaacccaagcacgcacacacccagcctggttgtgacagcacctgggctcggcctgaactttgcttcaaaattggaaggggtgccaggagctggaagaggtcaggcagggggaacaggcacttccgactctgtgggggcaggggagcttcctggatccctgagagcacagagatgcctaggtctgcagccacagctgggcagctggagctacacccaggatggcagggctcccaccctgccaacttggaagggggttaggttcctgcctgctccttgctcccaccggctccctggagcatttagcccaggtcatacctcctctgctgtagctggtgtctttgcagtggctgctccagatgggccactgctgccatcagtatctacagcctgactcagtgcccttctatcagattatgctgagggaatttgactacttgcttctactggaggcaagaaaatccaaaaacttggcagcccattggccaacattgcagctaattactctcaggatttagtgtatatgttttccagttccataacctctcaggaactggacaattaaaactatcaggacagataactctgatgcatgagtttgcatctttttctagagtttgcccttggagtgaagtttcagttctccttatgattgctggtttaatagcaatcttgttactggctaccttctcttctttgcctcactttctcacttccttatcactgttatctacacttctcaaaaaatatttatacatgaatattttgtgtccagattttctgttggagaatccacagtaagccattggacaccagaggtactacagtgtggggagcagagccttcagatgggatgctggagttgaatcgcttgttggccagttggtatcaagaccagttggcattttataacatcacaatgaccaagattatcccctatgtgaattgggatggcataaacatataaggttatgtatgccttatgcagtatttccagaatttgagatagtgacaatgataatgataatgactgtggagttggtagttgcaagtattgtcagtgatctaaaggaaaaaatgacttttaaaaaagcttcaactggtcaatcaaaatctcaggacatggtgtgaacatcacaagatctctataacaccatttaaagcaaccctctccttttgcagtttaaaggagattgagctaaaaatcagatcttgtgcctggttataagaatagcagaacagtagagaagcctcacttgaaagcaccagcacgccttctgtggaaaagtcagaaccttcacagggaaggagtaggaccctgaactctgggtttggaacatctgggtggctcacacctcactaaaccaagattctttcctcccctgaagaccacataaacacctcatctgaggttgatacttcaaattgtgcacatcttcctccaatttttttcttctttgtgacttctagaccaattattatgttcaagaccaagaatggcccaaatgaggaagtactgtctctgttttaacaataaaggaattattcatcaaatgaaccacagacaccggctaatatgtccaggtagatccagaagcacttagaagaacactaagagtaagtttactacgagtaaatcttctgagtgctggaaaaggtgtgtgtgcaaaatattagaaacacacggtagactctaaagatagtatttacctaatgtaatgaattcaaatctaaatatatatattttgaggtctaaatgtccacatccatacctagtagtatacctaattacatgtttctgtaaaatgttttaatttcagaaactaaaaatatatattaaattagcatactatcacattaatcaatgtttaaattatacaataattataaaatgtaaatctgtatccttgaaagttaattaaaatatataggatatgattcattttttaaagtcttgaagaatatccagcacagtcatttaacagattacattagctgagtttcttttgagaattaaaatgtaataaacttacactctttgaaaaactacatataagatctatataaatattccacttacttttacttgacccacaaaggcattggcttcttcttccaccacagataaatttcttggcagataaggatcaaacactggagcattgtcattgacatctgtcaccactatgtttactgtggcagttgaggtcttaaagaaaaacacaagcattaaatgtgagaggagctatttttacttagaattcatttaagtagtcattctggcatttgtctatctgaaaagcatctcatttttctttctaatccttagctttccaaaaaataaaaataaaaaaataaaaaaattaaaaaaaagaagcttgcaaagaagcttcccacctcaaaaaacagatgggaaaagcaaatgatgatattaaagggcaaacatctttttggaaatgtcaagtatttcctggaggaaaacggttttacctttatcttgttcacattttatgggtggcaagcttttgtttatacacacgtacactgctttatctctgaaatgtgccatttctgtagtttttgctgcttgtatgtttgactgtttaaaaataaaaccagtacattataaaatagcatggtacatcaaatgagcattttctggaaagctcatgctatcgaaaaatgctaccttaataattttctaggtgtacatttaaaccaagagtttgagtaccatatactaggcatgaaatgattatcttataagcatacagcttacggaaatggtatgcaggtaaacctaccagtagtgtgtgctacctagttaaaagttaaatccctggcctgctgcagtcaatattatgtaggtcaatgacttctgcacaatcaatgactatcttcataagtgattcaagctggaaactgctctctctaatcaaagcctgagtacagcacagaacctctacctagctctgtcacagtgtggggctgatcacaaaaggctgagagcaaaggtacagagagaaagaatattaacctggaaagtaagaaacctggtatgctatggtattaaatatttagtaactataaataaaaaggaggaggaaaaagcaaggtgatactgtcatgagagaattatccaccttttgtttaaaaaaatgcaagttccattaattagtaagtgatttgtagtgagaggctaaaatcctgagcactaagaagtgacttgagtgaagctgaaaaggttttgcagcagtcatggggctaaggagtcaagtgattttttttattttttatttttttttatttttttagctattaaagaggacagatcttggtaaatacccaatgctttctgttggggtcacagaagttctataccatgcaagtcatggtgcttgggaaaaagaccaaacctccctcaaatgtaaacccagtattgaaactctgattggatttaggtgatctgcccttattttaacagaagcaaaagcaaatactttttttagtaatgtaactttatcccaagcctctataaattttttcatgcacagtgttcagtagtcacttaataattaccatgcatagcagggaattcctgggtattagtgatggcttatttctttatttgtatgttggcttaccctttgaaaatttatgttgctattcatatgtgatttgcacacatttttgtatttaaagttaaataaaatttttatttaaagacacgtacaaagatggtcagaacatcattatatagtcaaaatctggaaacaacccaaatgtccatcgatagtagatggttatacaggattgtgttttatatatgcaatggaatcatatgaagtactgagaatgtacgaactactgctataagtaataacatggattaatttcatgaacctaagtttctagaacataaataacacatactatatgattccatttatataaacttcaaaaacaggcataatccctacatggtgataaaaattagaatacgggtcactttgaagaagaagatcgaatagcgacagaaatgatcacaaagctgagcttctggagtgctgattaatttctgttttttgttatgagtagtggttacataggtgtgttctctatgtaaaaattcattaagctgtagaattattgtttgtgcattagtctgtgtgttatattttcttaagattatttactttaaaagatgcacacacacaaacatacacatgtgtgtcgatatatgtaagtatgtttaaagaaattcaagtgctacttgactagatggaatccagatcatttcattttcctcgttacttttatatattttctaaatgttctcccaaaaggctaccatgctttcatgacaaaaagtattttaacaaatattatttctttaaaatttgccttagaattgaaagcagtaaagaagatgtgttttttacagttgcggtagttcccaatttgcctgagggttaacaagacattgaaatttacagcctggatccaaaatctaagaatggtgaccctggagtttgctggcttttcttcaaattgcctgaccccctttacaccagcctgtctttacctgtcaatccactgtttttctcatcctattctttaaaatttatattcatgttttcagagtattctgtatcctcagtttaagactgtaactcttaagtggataatgaagaatacaaccagatcactaagtaaactaagaagtcaaataacaattccataattttgtgctaataggggatgatatttatgggacatgcaggcattttcttcatttcttactgaattttatatgacatgaaaaaaatccatgtcttacagaaatgtacagtcacatctatacatagaataatttccagtttatatatttcttgaagttttttaataccacttgcttcagaaatacttatgtaaaaatgaggatttcagggctatccattaggtctattgactattgttctgaacctatggaaatatttataaattagttaggtgtaaatcatatttatttaatttttcttgattggttcagaaggatggcaacaatatgcttcaatgtggatctgtgccatagagaatgtttatgtcttattaaggaaagacttcttttcattgttcaagcttaaaaattagcaaatgaaaacagatcactttaattaattgttaggaccatatgtcattaacacatgttcacaattaattttaaatatgaatatatatataatgccagttaaattaaaaagatctcaaactaataaacctaataaataaaaagttacgtattttccatcaacggagtttgctcactgattatttcctcaaaagttgtattaacttataattccactagctggaaatacttgcatgttagtactaaatactgtaattgaacactttcatgttcattatttaatttaaatgtgtcttagaatttccttttgtaatatcatagaagaattttcaaaatatatgtctcattctcaacaatgcaagatatttctgtttttgtttgtttgtttgttttgagacaaggtatcactctgtcattcaggctggagtgcagtggcatgatctctgctcactgcaacctccgcctcccaggtttaaacaattctcctgcctcagcctcctgagtagctgggattacagacatgtgccaccatgcctggctaatttttgtatttttagtacagatggggtttcactatgatggccaggctgatcttgaactcctgacctcaaacaatctgtccgccttggcctatcaaagtgctgggattacaggcgtgagccatcgcacccagcttactgttgtaatttgaatacacatttatttttataaactagtatggctctgaaagaaggatattaatatagcatctttttttattttcattgttgttgttttttttgagacatgtctcattctgttgcccaggctggagtgcagtatgtgatcatagctcacagcagctttgaactcctaggctcaagtgattctctcacctcagtctcctaagtaggtgggactacaggtgcacgccactatgcccagctaatttttatttctttattttatttttgtagagacagagtctcagtatgttgcctaggtggtctcaaacttctcatctcaatcccaccttggcctctcaaagtgctggggttataggtctgagccgcgatatccagctcatcttttgttttttgttgttgttgttgttttttaatagtataaaaaaagtgagttataaagccatagtcaaagaaagtagtgtaaattcatctatcaatacacaatgcattatttgaaattcgtgagaacatacattaagagtatcttatttattctcttctagtatttcctatctcaggaaatgacatggcaaaataattaactaattttctaagtcactttatctcatacatgcaatttattagtcaccaagtcctgttaatttgaccttgtaaatgcgccttgtattatacagttttgagcaatggataaataatacaattttcatttcctgagtaaatagctggaagtcagataactgggttttctgattagcatatgtttagctatgtaagaaaaccagaaatgtgttttgctcaataatttaatgaataatttttaatacattttcttgttaatcaacttaatgaacacttttaagggcagtgtgtaatactacgaatttaataagcaattttggctttaatcctagagaggataagagaagggatgtttgttttttatttaatcacaaaaaaatgcatttttttatcatttaatttttacatcttttgacacaaaatttgttaaacatttcatggctagaaaactatttctttatattttgtgtgcatctcatagcacagccatttgttttgtgctattacatttatattagatgattgaaattcaatgacattcaatacatggtttaagaaacatgtatgcttagaatttatctgagcagagactcatggtatgtataggaatcagtcaggaatatttcaatttgttcattaagaaagcagaaaacattatcagaggtaaggtaacactataattatggagcacttatcatttatctatttcttaaataaaaacatgagtgtttaatttcaaaggtgcaatttcttttctatagtcaacaagattcactatatattctcagaaataataaagacattattttattaagaaatgtgtctaacgtgtttactaatagaacacacaatgtcagctcaatgaatatttttagatactttaaatatctatttttattataatttgtactacatgctgaaataaattaccttataacttattttatttaaatgtctgaaaaaagaagagctagaaagaatattgaaaatttccatctgtgagaaaacacaagaaatgttatttatagaacacaaagttttcctatctgaataaaaatcttcactactatatctaaaattcttttcaataacaatgggacaatgaggatttatagtttagaattcaatcattttttgtttaggccaataaaacaagaaaaatacatattcaataataagtatagtatttagagaatattaatttaaaacattttcatccttaagcgcaagtcatcttgttgctacacagttcagagccaagccaacttcattcagattgtagagtttcattcatgatgtagagtggaggtccttcctaccattaaagattagccaggaggctttctttccttctgaaggaaaaaaatatacataaaatctagaatttctttgagaaagagaaaagggaagttccttctattatgaattacgggaaggagaaagggagacacagaagagacatgaaggcaggaggcagaggtcctcctcctcatcccctactgccactttggacccctccttaagtgaagaggcactggagaaacattttggaagaagggggaaatgatgactgggaaactaagagaaatttgggtgaaataatcacagtagttttcaggagtatgtaagcctccagaaaatttccacaggttccatgggaggtcccatctaataggttatggcactgaatatacagcaatggcagagagaggtgtcaagagagagaagccatactaccagcataaaggactggtaaatacatgttacatctagaccacaattttagaatgaagtcagggaggagaggtttggttggcagcttaactagtgagtatttatattgtcttaaacagataatgctgaaatactgttctaagaaacttaagtgtgacccagattacatctattccctacctgtccaaacacatatttatacattattgtctaagtaggaagattgcatcaggtataaaaaataaagaagcttttttttctctgtgcacatctgagtgtagtgtgtaaagattatatatgtatgtgtgtatgtatgtatacacattttatgcaatcgtgcatgtttttatataaatatatattttcaaaaatatcagaaagtatttatagtatacctgtatactatagtatatataatatagaactatagatataaatatttatatatttgtacataaacattttgcatgttacatatattgtaaagattcacatatatgacttaaatgtttaaagttttactattctataaccatacgtattgtgttctaaaatattaaatcaactattttgaaattcaaagttactttaacttcacacattttctcacgcatgtatttttgcttttgttaaagtttcctatttgattatgaagttaaatgctcaacttttaaatgttaattgttcatttatattgccatgtttcaaagaaatttaggaaataatattgcttcaagacaaaaacaaagatgctaagtcttctagcaatctgaaattgtgaaatattacaagtgttcagactgaaagccataactgagtaattcaatccagtaattcaagagcattttacagaaatcaaaccatgatggaatcaagttacctattgtatcaattaaggaggaaaataatattgctgaacacacggaatctggtcagaaatatctaggctacagaataacttcacattttaaatgaaaaaaattactgatcactgttcgcatatttatttatatctttcactgtgttattggttgattaacacagctgcaatccataagccctacttcctagctatttttctacccactgttgctacttacagataagaatatctaaaaggaaatctgctagatggggtttctgaaaaaactttggtgctttgttaaaataaagcaggggtgcagactcttctggcattcatctttatactttgtctggtatagagaattgacgtctagagttgcagaagatgggaatgaaagtagacaataaaaatggcaaagcagaaaatagccagcaggcatcctcaatggcactgatgtgcacctgcaccatctcttcactgtccacctctagattttttttctgtatttgtttgtactatctcaatttttaaatgtaaaatgttgtggtattaagtatattcatattcttgtgcaaccatcatcactatccatctctaaaactcttttaatctagcaaaacaaaagctctataacattaaacaataactccccatttctcttttctttatcctctggcaaccatcattctactttgagtctttgtgatttttgaccattctaagtaccaaaatataagtggaatcatatggaatttaacattttgtgactggctaatctcacttagcataatgttctcaagatttatctgtgatatagtgtatgtcatactttcttccatcttaaggccgaatgatatttcattatatgtatataccacattttgtttatatattactctacataaacatggaaaactgggttgcttttacatcttagctattgtgaataatgctgctatgaacatgggaatacaaatatctcttggagactctgctttcaatttttttgatatataaatgaaagtgtgattgggggctcatatagtaattctatttttaattttttgagaaactaccactgttttccacagtggttgtaccattttacattctcaccaatagtgcacaagggttccaatttttccacatcctcatcaacatgttatgttgttgttgttgttttgttttgttttctgtttgttttttataatagcgtctctactgggtgtgaggtggcacctcattgtggccttgatttgcatttccataatatttagcaatgctaagtgttttttcatatgtttactggtcatttatatatctcctttggaaaagtgtctattcaagtactttgccaattttgaatcagtttgtttatttttgttttctttaaaaaattctcgggctgggcgtggtggctcacacctgtaatcccagcactttgggaggctgaggcaggcagatcacgaggtcaggagattgagaccatcctggctaacacagtgaaaccccatctctcctaaaactccaaaaaaatagccaggcatggtggcaggtgcctgtagtcccagttactcgggaggctgaggcaggagaatggcctgaacccgggaggcggagtttgcagtgagccgagatcgcgccactgcactccagcctgggtgacagagcaaaaatccatctcaaaaaataaaaaaaaagatctatatattttgaatattaatgacttatcatatatatgatttgcaaatattttctcccatttttatgttgcttttttattctgtgtctttgacacccctttacaaaatcacaaattccaacttgtctattttttgttgttgttgtctgtgtctttggggtcatagccaataaatccctgacaaatgcaatgaaatgatgcttttgccctatgttttcttctaagagttctatagactcagttttcattttaggtcatgaatcacttttgagtttgtttttgcatatgatgttagataaggtccaacttcattcgtttgcatgtagaatgatcatagcacccatcttaaaaattatctgaccaattaagtgaaagtttatttttggattttctattaaattacattggcctgtatttctgtttttatgctagtactactctgttttgagtattgtagctttgtagttagtttgaaatcaagaagtataagttctccagctttgttatttatttttctttttggctatctggggtcccttgaaattttaaagataagttttagaataagtttgtttttttaaaaaaattatttctacaaataacatcattgggattttaatagaaattgcagtaaatctgtagattgcttgggagagtattaacattttaacaatattaagtcttcccatccatgaacatgggatatttttcaatttagttatgttttatttaatttctttccaaaatgttttgtagttttcattatacaagtcttttatctccctggttaagttaattcctgagtattttattcttttggatactattgcaaattgaattgttttcttaattaactcattcattttcaatctatgaaaatgcaaatgattttgtgtgctgattttgtactctgatactttgcaaaatttcttagttccaacatttgtgtatgtgtgtgcaaacatgaaacatgtgtatggaatcattaaagttttctatatgcaaactcatatcacctctaaacagagataactttacttcttccttttcaaattggatctttctctctttctctctctctcttttctttctttttttgcctaatagctctggtgaggacctctgatactatgttgaacacaaatggtaaaagtagacacccttgttctgaatcttcaaaaaaaaattagaatcgaaaaagtatagttttatctgtacccccgatagctaaaaaaaaaataaattacatgacacatgcaacttatacagatttttcaacaatcattaacaaagaaaatttagaaaaggacagtcaaatcaaacttcctccatactgtctacaaataaactcacaatgaccaatagaatgtgacctcttatctccatcatccccattttgagatggtagaaaacgtgtattctcatgatcaaattttcaaactcatcctggcaatttgtttcacacaaattgcttgttaacattttcatttcaataaattccatccatctgtctgtgtttattaaatatctgttttaaaccacatgattcttaagtttaaaaggttaattttactgtaattactaaatatttagataagaaaagtgctattaagacgtgagaatattattgttatataatcactttttttcttcaggaacccactgtgtatgcctacatataagtatatccgtaaaattatataaatgatggaattaactgaataaacttttgtttgaaatctaaatgctttctactctactgatattctcattacaaactttacaaatgaacacaaaatttactcagaaaatcagaattttaaagcaaaatgaaacctgagtgattatatgaggaaacgaggacctagaaatgctaagtgtcctgtccaaggagaattaaaatatacaaataaattactgaacaatgaactagaaagaacaaaactactgattttagcccagaacttattttggttttaagtagtcaaaagtattattagtagattgtgactattttccttccatctgtttccttgtctaagaaactttaaggacagacttaaaatgttctagctaatattactgccattagtttctgatttataatgtggcatatttcaaagctatgtattatcctttctttttttcctattttattggttgacctgaatgctttcttaatttcacttcactgtaattatacctcttaatctatgctaaataatttctccttctcctccttagaatattttctctcacttattgcctagccgagttaccctctaaactttcatcataagtcaagttcttcaattacttcctccagaaactctcactgacttctttacatacatctaacacagacatactgtaataatttagggcaggctgggcgcagtggctcacgcctgtaaccccagcactttgggaggccaaggagggtggatcatctgaggtcaggagttcgagtccagcctggccaacacggtgaaaccctgtctctactaaaaatacaaaaattagccaggcgtggtatcatatgcctgtaattccagctacttgggaggctgaggcaggagaatcacttgaacccgggaggctgagtttgcagtgagccgagatgtttccattgctctccagcctgggcaacaagagcgaaactccatctcaaaaaataataataataattaggtggattgcttatataaaaattagccataggttttatttacttttctatcatctaagtacctattatcctcactgtttactacaactgttctgtatattttattatatgtataagtatgtttatttatgtaatgtctgaaaaatgttaaatagcttactatggacagactgcaattaccaaatttaattatttctatttatctcacttttagttaagatgagaaaactattcaggtatcaattttatatttttattataataaaatctcagaaatcctcctaaaataaatgtgaagatacatttattttacatttattattacaataataaatacattattattgtatactttcagccaatgtagtatatagattaaatagatcatttcaaggagccaggagatatgttgatatttaaattgagtgagccttgcttatcaatctgtaatgggtttgaaattatttctagacaatagcactgagttgacacataagcacctgattgaaaaaaaaaagagaatcacctaacacatggcatagaaatggtgaaaataattattaacaatggtaatattacaatacatagaaagcgggatgctggcagttgtgaatgagatcgttcaaataacacagacaagtgattttaaagcagttcagaatgtctaacaattttttttttttaaagtgagttttaggtccaaaggaaatagaatttatcttctttggaattataagcccatttaaattatttagataaccaagaattacttatgattcttactgctacttacaaatgcctgtggaaacaagcaaatcactttcctaagtgcttaaagatatttatccacaaaatccactcttcctccctgacccttaaaaaaatgacgctaagtgtaacaggttccaacataataaactgccagaacacatttcatggtgcagtgcaaatgacagacacaatggaatacctgttagaataaagtagatttcattttccctacaagttaggtgagaatgctgatctcaagtatctgttctgtcaagtcaaaggttgcagcacaatagcaaattcagagtataggtgcatgtattaatagcctgttgaagaaaagagcaacacttctagtaattataagaagttgctccagatgaaaaacattaattcatgtctgtgatacattgtttaagactctctcagttgccttaatactatttttaaaaccccttcacagggagcatactcaccccatctggcctgccatctgaagctgtgatgatcagaatgtagcgatcagtgctttccctgtccagtgctttccctaaggttagaatccccgtgctagtgacaaaacaaacaaacaaataagacaaaaagagatattatgtcacaaggagagtcttcttagtatagtgaattacttttgatagctttttttcccctctcagtaatcacagcttgagtattttagatgtataatactaagattcattctgaaaattgaaaacagcttttaaggctgtcaaatttcttagcagtatccatgaaactgacactgagctgatttcctaccttccaggaaacaaaacataacaaaactgtgcttaattcattccaagaagaacagtatctatcttgttttcgattatttcaagagaaaagacttcattattccttagcagtctcagaattctttgaaacaaggaatggtttcctataactaatgtatatcacctcccaatttatgtcatatgtatgtccattatgaaaatgcaaaaacccatctaaatgttatctctgacaaactctatggataaaagtttttcttttttcttacttttaaaataacagagacccattgtacaaaattagaaaatagaattttttcaaattacagaaattatgttttttgtaatgtttctttttgtactttattataaccacatttaaatatatgattgtttcagaagaggaatcattctgcatattttacattttttaagaaaatataattgtattagaattcatgttctcattttataatttgtttaaaaccccttttgtggctacactaacaattttagtattttgttattctttggaaatttagctgtttcttaatttaactgatgtataatgggagattaacagcacttgggaaaattattgcacttacaatatttttaatacctactccttatcttttcactgctcagaataaatgtttccaaatatttaagactttattcacccatgtaatttattttataacagtttggcttgctctctaatgtaggttctacatttatttcttaaattttacatctgatattgtacacattttaatcgagcctaacaagtatccactgtgtagaagagtttatctgaatataataacacattaaaatatatgtaccaagtccaaaacataaattgtttctaatggataaaatgctttcattttaaggtaagtgcttttattgtaaagaaaatttaaacaattcatatcacatatggtagttgagtacagagagtcaaagccgatgaatcaaaataagaatcacagttactcaatttgcttattatgttgtaatggttgacgtggactttttaaaaagttctgaacatatggcatgcccatgaaaaactgactttgcttcctgtacattttaaaaatgttttgtcaaaataattgaaaaccagttcccagagcatgttcacaacaattaagtttggaccagcttcctacagtacagaaggtccagataatcccattttaaaattacattaaatgagaaaagtaagacatgtatttcttctgaggcttattcacaagtatcttaagaaacaggaaagctgaaaacctagccatggtataataagagaaagaaagaaaattgagttaccattttcattttgtttcttccctcagttaattatctatattcctccttgtacattaaattagaaaattactaaaaagtatattgtatatttacgatgaattacaaaactcacgtgataactgagttgatttcctaccttccaggaaacaaaacataacaaaacttcgcttaattcattccaggaagaaaaatatctatcttgtttttgattatttcaagagaaaagatccattattcctcagcatgttcagaattctttgagacaaggaatggtttcttataaataatctatatcgcctcccaactgtatatagtatttggaatatatatgtatactctatatatactatttaggatatataatactatatgtattattccaaaaatactatatgccgtgaacaatatagtatacagtatattcatacttagggccattttaaacacaaacagctaattgtctatggtctggtgattattatagaggtagtttttatgtaatacgcgggccttgcgactcagtgttgtaggcagttgtgtggtatatttgggcaatgcagaaggggagaaacacaggcagtgtattttgggattcatagctgaaagactagtttatgggtttacctgtgcatccttttattaaatccgagaaatagctcacaaaaagtcttattaccagctagatggaggctatcaggccaggatacattggggtacacttagtaatgcaatacaccttataagttcacatattaaaaatacataagcttcttcaattgataaagcatcaataacactgctacttatacaggattgaaaatacatttcccaggagtgatgtcagtggaaatggagaagacagccccaagagatggtctcgccacaaaacgtcaaaaaatcacaattaagcagggaccttcaacagcaaatttgatgaaactctggaaaacagtcacaggtttatagcaaccagatgaaggcagaatttgttttaaaaaaaggtaaatcaaatctggtagaagaactctgtggcattttgacttgtctttatcctaccatctcactggctcagagtggccttgaaaacatcagtgaacattcccagtgtgacactatggtctttgtttctggagggagcgagctatccttattcataaagaactgtgggggtctattctagtctgtctggagactgcctgaaggagtgattcatggcacttatctttgtttcatcaaacttggaaatcactcaaagcagaaaagcagtgggcattcctcagaaatattgtaaggcaggggatagcccacaaacacttgaggcgtataatagagtgccaaaaacttgccaggaaagtctgggtaaatagtttcatggaaaattcaggcactcaaaagtgtactggggaatacagaataataaatataattgagaattcataaatatacccacacatctacagtcatctgattttcaacaagaatgccaagaccattcaaaaggaaagaatagtcttgtcaacaaacggcactggaacaaatggaaatctatacgtaaaagaattaagttagactacttcacttcatacacagctattacctcaaaatggatcaacaatttttctaaacacaagaattgaaacctgtaaacaactcttagataaaaactagaggtaaatattcataatcttggatttggccatggattcttagatatgacaccagatgcacgggaagcaaaggaaaaaatagatatactgaacttcgtcaaaataaaaaaaaaaaaaccttttgtgcatcaagggacattatcgagaaagtaaaaaaaacaacgcatataactggagaaaatacttacaaatcacatatctggtaagagtcttatttccagaatatataaaggattacataacttaacatcaaaaagaaatcccaatttaaaaataggcaaaagactcaaatacacattttttccaaagaagatatacaggatatacaaataatcaaaaagcatatgaaaatatgtcattagtcatcaggcaaatgcaaatcaaaacccacaaccaagtatcacttcacactcactatgataattatatttaaaaaaagaaacaaccaccattactaacaacaacaacaaaaaataattgttggcaaaaatgggaataaatcagaatcctcatatatttctggtgggaatataaaatgcttcaatcactgtggaaaatatttgacagttcctcaaatggttaaaaacacataattacactattccctagcaaatctattcagtatatacttaaaaaagccaaacacaggtacttaaatacacgtacatatatgttcacagcagcggtatttgtaataccgaaaggtagaaaaacagcttaaacgtctatcaatttatgaataggtaaacaaattgttgtatatgcatgtaatggaatattacgtagccatgaaaagtagggacctacttgcacatgttgcaagacagacgaatcttggaaacattaggctacaaaaaagaagctagacacaaatagtcacacattgcatgattccatttctgtagaatattcaaagtaggtaacttgatgaagccagtacgcagattggtgtttgccaggggctaagggaaataaggaatagggagcaattgctaaatgggttcaggtttctatttggagtgatgaagctattttagaactagacagagttggtaggtgcatgagttctgaatctcctaaacaacactgaattgttcactttaaaatggttaattttgtgctatgtgaattttgcctcaattatataaattatattgcagagtattttccatcaccaagcttttgggctacgttcctgaaacatattatgcttggcatactcaattattatagaaaatagggtttgcctaactataaaaatggtgttcaaacataatttaaaaatttggccaggcgcggtggctcacgcctgtaattccagtactttgggtggctgaggcaagaggatcacaaggtcaggagatggagaccatccatcctggctaacacagtgaaacactgtctctctctttttttttaatgtgcacttttttttttttatttttttgagacagagtctctctctgttgcccaggctagagagcaatggcatgatctccgctcactgcaacctccacttcccaggttcaagcgattctcctgcctcagcctcctgagtagctgggattacaggttccctgggagcttatttaaaagctctgtgccatcagttttcccttctgtcaaatgggaaagtgaaaccccatctctactaaaaatacaaaaaattagccgggtgtggtggtgggtgcctgtagtcccagctacttgagaggctgagggaggagaatcccttgaacccaggaggcggaggttgcagtaagccgagaccataccacagctctccagtctgggagacagaacaagactccatctcaaaaaataaaaaaaataaaaaaataaaaattatcacctgtagtcccagctacttgggaggctgaggtgggaggatcacgtaagcctagacttttgagactagcctgggcaacagagtaatacccagtcttaagaaaattcaatgatgtaaatagaaagtagcagaggatatctacttccaaacaaaacaagctaccgaatttaaaacctgcttctataagtaactgtttttcaaaattccgttattaggaaataccgatgcagcatcattataaactattatctcacatatttcatgatgtataggctttgcttatttaaaattttgttaaaaattctacagcttgtgactgaacatttacacttggaggtgtctgagcctttgacagatttatcacattgcttttgggcactgagtttcaggctttacaatgatatttaaagagattagagtatactttaaaatgtacagttgcttcaagtttgacatggcatttcatattaaatagcaattagcaattaacaaaaacctactaataaagggagctaggtattgacagcagtttggggaaaagatgatggtggcatgaactaaggtagtagagtgaagtgtgagaaatagtttgatttgggtttaatattttgaaagtagagctgagctgtcagggaataaaataaatatctttcttatatattatttaattttcaatataatcataaaattcaaactgatatgaaaaatataattgagcattacatgtaatgtcaaaacaaattaatcaccaaagaaaaaattaaaatgcaagtgaagaaaaaaaattttaatagaatttggaccagagatggagataatttttgaaattctcttatttagcactgattttaagtgttggcatcacagaccccatgcttcagtgataacaatccataaatatttgagagatggcatttcctcaacctcccttaataaataactataccattaggccatcatatttataagggaagttgccatatatcttatttaaatgtgtacttatttgtggatgattgctgagtgaatatttgctaaatcatatgccactatcaagacagacactatgaaaagatactagaaaaatgcattatattagaatcatacagatatggccacttaatacatgacactgaatgatttgtattaccaatgtttgtgatttttaaaaaaccaaggctttttctttaaagacccagtttctttcttggctgtgtgactaagccaatttattaaaataataattcagtactttgtaaaaccctactgacattaagatgattattcattactactaattttttaaaagaaatacaagaaaattttggcatacttttatttcattaaaggaaagtaatggtattataatgatgcgtattgagagaatttgcattatagcataaaataatatggtatttaaagtatacaatagacatgtaaatattttttcattttgctttaagatataaaatataacccaaatagcatatattgaagtgtctgatgaggtagaacattgtttatttttttagcgtacctgtcttagtccatttgtgttgctataaaggaatacttatggctgggtaatttataaagaaaataagtttatttgtctcacagttctacaggctgtataagaagcatactgccagcatctgcttctggtgaggggctgagagtacttccactcatggccaaaggtgaaggggtgctggtgtgtgcagagatcacatggtgagaaaggaagcaagaaaggaggggtggtgccaggctccttttttacaaccatttgttgtgggaactaataaagcaagaactcattcattacctctggtaacaagccattcataagcggtctgcctccatgacccaaacaaatcccattaggccccatctccaacatgagggatcgaatttcaaaatgaggtttggagtgtcaaatatccaaactatagcagtacctggattgttcatatccttgaaagttatagagaagtggtagtgcaaagttttgaacatgaatctcagaagtttcaaagaaggtggcagttgaaatgtcagttattgttctccatttcaaatgcattgaaatgtattgctagtggttcaggctactctataaatatcaatgagaacaacagcattgaggtggtggaaacaaagtgaccataggatagaaggcaaagggcccagtgtacaggaccctgaatcaagaatgatcatcaaaagggatcacacaaccattatagggacatgttctgctttagctttcctggaagcagtttgtgtcttaaggagatgtctgtccaggttgacctaagagctttaacattaagaatcatggtcaatttagactaaaaggattttgcattgacataatttacacctttaagaacctctgtgacccagccattatctttttcattccaaatgcagagatgagaggagcactagagatataggaaagcagtgcatttagataatttatttggcaaaactagtagctcactggatttcacaatcagcaattgaaaaatctcttggcatcaagggaaaaacaggaatagaaattcttaagagacctgggcttcctgcttaccagagcaggtgaaaacttcattgttgtctttttcttttgttgacagctttgttaacattttaattcagatatcataaaatccaccaatttaaagggtacaattcaatggtttttagcataatcgcagagttgttcaatcatcactgtaatcaattttagaacattttcaacaccatatctattaacagtcactccccattctctcccactcctcattttcaggcaatcattgatcaactttttatcttatagatgtgcctattatgaaaattttatagaaatgaaataatataatacgtgctctttttgcaactgacttatttcacttagcataatattttcaaggttcatacatgttgtagcatgtttcagtacctcattaccttttattgatgagtaatattatattattacagacaggcaacattttgtttattccttcctctgtagatggatatttgacttgtttccacttttgtaccattgtaaataattcttttatgaactttctttgtgcaaactattatgtagatgcacgtcttcatttctcttgcatatgagcagaatgctggcttatgcggtaattctgtttaccatttggagaaaaggccagttctccaaagtgtagtcatagtttgaatccatgtccttgcccaaatctcctgtcaaattgtcaccaatgtaggagataggacctgctggaaggtgattggctcatgggggcagtttctcatgaatggttgagcaccaccctccttggtcctgctctcttgatagagttcaggagatctgcctgtttaaaagtgcgtggcacttcccctccctctctcttcctcctgctcaggccatgtgaagcgctgactccccgctttgccttcagtcatgacttttaagtttcctgaggcttccccagaagcagagcaggtgccagcatcatgcttcctgtatagcctgcagaaccgtgaggcaattcaacctcttttcattacaaaatactcagtctcaagcacttctttatagcagtgcaaaaacgaactcacacatgcacattttacatggccacataaatttacgcagatttcagtatctccacattcttagtcatacctggttttgcctttctttatcactacagacacaaagtatgtatgaagtcaaatctctttacagttttaaattgcatttctctaatgacaaatgaacagtgatcgtgatcatatttccatgtgcttgttggccattcacatatccttttttaaagaaatatctattcaaatattttgcccattttaattagattatttctctttattaagttgtaacagttctttatgtattcttgagacatgtttcacaccatatacattattttaaaatattttctctgattgtaggttgtttctcactttaggatggtgctccttgaaatacatttttaaaaattgacgagacccaatttatcaattttatcgttaatctttgtgcattttgtgtcatatctcaaaatgtactgactaatccaaataatgaagatttacttctgtattttcttctatgtggaatgcagttttatctcatatattgcaatttatgatccactttgagttcatttttgtgaatgatgtgagataaaaattgaaattcattctcttgcatattgtcccagcttcatttgttgaaacaaagttctttcctgattggattatcttgacccctttttgaaaatcaattgaccataaatactagagttatttctggattcttaagtctgtccaggtgcttatatatctatctttatgctaatactacacagccttgcttaaagtttttaacatttttattttctttaatgatgattgtaaattgtagctaatttttgatttctacatccctatgagataaaaatgaaaacagttaaggctttttatttttcaaatagaagtttacttatctgtggaaaacactgttcttgtctatagtttcccaggcattactaactcatgtttgtaaaattctatttaacgtgaaatttcaggtatttctgggaagactaattgaccagcacatggttctcttgttttggcattatgccccacatgttcctgagtctgatgtggcaatgtattcatttgtcaaagttttaactttataatcattggccaagtttacatttctattccttctgaaagtaaaactattcacaggtacacaggaaatatcagggaagagccaagctctttagaaaccagccacatgtgacagcagaacagctaccttgctattgcaaaagggaagcatacagtctctctgaagccctaaatgcctccttttaatgcctgctcccagttttctcaatagttatcattagcaatatctcagatgtattcagagagataagtagaatgacactgatctagacctcaaagaagtttggcatgaacacgtattttatttcattgtgctttttttcttaaatatacctatgttaatctgaaattgaaggatgtgtttgtaacacatcttgcctacaagcctccctttgaatacacagtttggtgctaagtaaccctttgtagtaatgtccttgtcattatcagtagctgacaacattaaaaggatctaattaatcccagttgtgccttccaatgaaatgtttccacctcagtagattttacctagtaaaaatgttaaaaataaacagtctcctgggtaatatttctgggctcagaattatcctcccagctaccattagcattcatagaaaacagaaagggaagtacaactacaaacagctgaaagcctctgattagaagtctgctttcttactaacagtacgttgctgtacatttttttaaagtaggaaatcatttttaacttacgtttctgaaagattaaaaactctctgaggatctccattctcaatggcatatgttattgagtctccctctcgatcagttgccttcagagagaaaacataattcaattatcaagtaattgatatggcgcccactcattacagagtaatataaaagcttgaaactaatagcacagaatgtccatgacactgttaaagaataaagattaaagcatggcctaatggcaaggtgtaaaatcaaacatttcgtatctgatccatttctgaatatgtaatcctacctgatgtggaaataatcattttcccaaggtttacttatttaattaacttaattaatgaatttaatttcaatgtctgtttataatttaaataaaagctgctggctgggcacagtggctcaagcctgtaatcctagcactttgggaggccaaggtgggcggattacctgagatcaggagttcaagactagcctggccaacatggtgaaatcctgtctctaccaaaaacacaagaagttacccgggtgcagtggtgcacacctgtaaccccagctacttgggaggctgaggcaggagaattgcttgaacccgggaggcagatgtttcaatgagctgagatcatgccactgcactccagcctgggcaacagagcaagatcttgtctcaaaaaaaaaaaaaaaaaaagtgctaaactatgtttacagtgtcgataaagtgtttaatgtatattcttttctttttctgttcagaatatatcaagacaataattcaaatcagtctaactttctggttaaaaatcctgaatttatagccacaaagcatgacttcaaaaccgggctccaattgtcctatgtgattatttctgtgtatccatttctaaaacgaggactatacaacaatacaaatgttaatagatgttgagaggtttaattgaaataatatatatcaaggcacatagactaatatctggtacattgtaagctttcaataaatattaacctttttgttggtttttcttcccttcaacacccaagtcggagaagaaaacatatagtttgactttgagttccgagtttctcttgaccaaaataaagatgctcttgttttatggcactgaggtctggagttttaccttaaaaaacatcaaatcagttctttttccagtgagtcattcgatcctcttataaaagacatggataaagaaagaaatttggatgctatcagagagttgacagaatgatctgcctaagcatgatgctacagggggggatatatctgataaaggttcagatgtattttatttttaggtgactagcctggcagaaacaccagcctctccacagacaggaactgccctggagtcagcaggattctgagagaggaataagtatgtgagtttctgtcagtgactacataataactgtcccagccataagaggctgagtgtgaaattccctgtccagacaggcaggaacgtattgttcttagtggtagatcagttggctttgacatggattacacagtcctgctcacagaacgtccttatcagctaccacaatggattgatggccagaagcctctcttggaccacaaaaactacagaatcaagggaaactgaaaataatatttcagtcagtaataaactactgaatattgactatgtgctaggttctgtaagaaaatctttgcaagattatttaatctgtctctcataaaagtgatatacttccttcgcatggctcctatgacatcatattgtcctgctttcaatcctcacattatcaatggtagttcctcattttcctttgctgatttctcctcattttataagacttattttatattggattgttccaaaggttggtccttgaacttcacttatttagtcaactcattcaacagtgtagctataaatactgtctatctgctgaagacggtcatatctctaggctagccctttcctctggatttcagatgtgtatccaattgcctacatggatccacattagatgaataataataagcctccccaatttaaaaggttaaaagccccaaatctagatctcctttccatcttgacgtacctcaaaaaataaaagaaattcaaacaataatctattgttttcactgcttcatcatctcagtaagtacctgcaactccatcctcctactttctcagggctcatagctacactttgagggctcactcttacattccaatgcaacccatcagcagatcccaccagatttacctaaaatatctgctgtatctggctgtgtctgaatttcttctctgccaccaccttcctcatggattatggtagtaactattttactaacgtgttgcttcttcccttgtatcctcacaatagtcaattttcaattcagcagacaaaagtacttgtttttccaggccaattcttttatttctttggggtaaagtctattgctttctcccccagctccccaccctccccatgccatacacactaaaataaaatggaatcaaaaaaagtaaatgaagaagaaagtaataaattagccagggtaaaatatttttgaaacatcccatgttagtcaaaatccaaaattttatatttcattgagttagtcataatggaagcctaggagtagaaaaaaaagaagcaaacaaatttctaagaatacactcaataaaatggatagtagacgcttgatatttttcccttgcattctgttctttgctagataggaaccacaaataatgatactcagctaacattttgaagaatcagagaattatatctggagactatatcttaaccccaaaaagcttacagtgaactttttctgttgtttttctctcggtcaataaatttttcttattatgttgttatagatatgatcatgttcttttggtttgtttattgatatgtggttgctgttttaatttttttcttgagaaacattttataatcttgtgtttcataaaagccagaagaaatgcattctgaaacaagatagcttcatgtaaacaattttaagaccagattaatatcgaatcttttattatatcagatctactctaatatttaatatcctttatgtaagatgagaacactgtatttatatttattatttttatgttaattcctttcaatcccagaggtagcttgaaatatttcttcagttttatttgaccactcaaatacctcagtcttttaaggattgtgaatgtcaacaatttgcctacttcattcttatgtgaggttatgcccatattggaaactttgaagacttaggatttaaaagaaaattcttatttgattcctttcttcatttttatcttttcacacaatcctttattggtgttccagggtcgagggtggtataataattaggaagtatttatagtttttcagccaagaaagcaaaaggaaatggtgtaatctgtatcaaagttctgcaatctatgcattacatgagttagcacttgtatagacaatatcatctttctttgtcaatgtccaaaggtgagaaataatccataaaaagaaaaattggaaatatcaacagaagcatttacccttcaagtattaggatttgattatgtgtgtatatgtgccctaaacatatttctatcagcaatatttaaatgttttctatatataaatctaaccagccatctcaaaataattgcttataatgtgtcagaaactatattaaaattttgcatgtcttgtctcatttaaacctaatagtaactttactggtaaatagaaaatgcatatgacttcaattatattactatttctgccatcattccaaccagatttctctgtactttaattaattgaaagatgcatcttttttatctagagatagtaataactgtatcatcttgaaaatgggagcatagtgttattcagtattttccataatataagagatataaattgcttctttttagtgaaaaaacattttatgtgcttatttttgataaatcaagtcatatccgagtcccttcttcaaagcctgagaaaagtatgacagcagttatctttctggggcttattttgagtttaacgggggagattctggagccagctacctggattcagcctcagctatactatctcttctcagacaatgcactcaagtacaaaatgagaatactactactactacttaatcactcattaattcaacaaatatttattgagcatctacgctgtgttaggcactgaggctgcagcagtaaaccacacagacaaaaatcctgcccttatacaatttacatggtagtggaggaaaatgaagttaaaaattaattagaatattttgttttcagatctttatacgcgttgctcaactacaaaatatttcacaaaggacatatatggagagcagggtgaggatttacacttatagaagtgatcatgacagacttactgaaaatgtgaaattttggcaaatgcttgtaaaaggtgaaagagtaagtcacgtggggaagaacattccaggaagagggcagagcaagtgataaaggccgtgaggtgaaaacaggcctggtgagtttcaagaacaacaacgaggttgtcaggtctggaggcaagcagcatgtggaagaggagctcctcagtgtacttcgaccactttaatacctcaggttaaacgaataaatgatgtgtattttggatagctggcaagtaatgcactttagccactggtttgctaatatatggttaataacatggttaagattaaagccaatctttcctttaatttttatttaatttaatataattttaattttgcctgaagaacaaatgattcctttaaaaatcaaagcaattactctttccagtccactcaaccagattacttgcagcatctgacttagagtccctgatttttcagaagcaccaatagggaaacaaaagtatttatccaaggaagcagtgttcttagacactggcaaatggaaaatttggaaaagaaaacaaattttctctaaactaatcttctgttcatgttaaagatgaatacagccatcaaataccgtctgatagagtgcattttatgtgcaaggaatgattctacacatttcacaggacattaagacaaagtaactgcccttagggattctaaaatagataaaaatcaatggatttggatgattttctcacttaggcaaacaagttctgatttatgttattaaaccacttgagagcaacaaataaagctttcaattcagtacagcagtgtttcaaaaaatgtatacattcattcctggtattacattttttggcctttaacaaaatgttataatatttaaataaaaattaatgaatatattttattcatgtcaagtactgttattttgtcattcataatgataatataaaatgttattttgaagtaagtgtaagtaaaaggtcagttcattaaatattccaaacaatataaaatgaataatattatatagaatatacatataacatatatgaaacttggaaatgtagctaaatctacaatgacaaaaatataaatatgctcaaaaataaaagaatgttggaaaactgcacacaggagagccataaaacagctctttttcttacaatattggtatggattaatgatcttttgcccaggaagcaaaataaaatgccttatgctaagaaggcatagcagaatcactgctggtagtgttgaaaataaatggcatttggaagtgagcataaatttatttgtcacatccagagaagtgtctgtaaattaagaagtccttaataggaaaaatacctagacttccgttagatttagggatactctatgaaggcttagtcttaaaaaaattttgttgtacaaaatgggtaaccttggaatacaaagagatttaatcaattctaaaataagcctgcaattctaattttgtctagggctcaaggaacaatcaacaaaataaacttagaactaatgtaaatattcaaaatgacgcatccaaataatggttaccattatgtattaagcacttttaatatcccatctcatttaatcctcaaaacaatcttctctggagagcactacaatccctattttacacataataaaatcttaagcttaaaaattaaataatttgccaaagtttacaaactatagaatcataattcatattctatgccttttgaaactcattttctatcactagcaaagtcccctatgtcctaaacttatctcgagtttcccttcacctgcttgcttgaaccaacaccaagttcttcttaagaaccctaatttcccagtatcccttttgattggtgagcctcagagtagccttcttgtttctcaatgtcactgccagattattcttctggaaatgcatcagctttaattcttataccataagcattatactgcattaactgctactcttcattgttaaagtcatactctacactatttatcatacttcctgttttttgctcattgtcagtctctctctttgcctgtcattgctgtcattgtcaacttaatccaatatcaaagtttcaaataatatgtaaaatgctaatgacttcaaaattgtatttcagttctggggctgagagattcaagatcatggcactagcagatcccatgcaccttttgtggtctgcagacagctgtcttctcattctacacttacatagtagaaacagagagctctggtttcttcattccccataagggcactgaatgccattcatgaggactccactctcatagcctaagtatctctaactaccaaatgtcctacttctaaataccatcacgttggggattttggcttcaatatgtgaattttgggggaacacaaacattcagtccatagcagatgtcaaaaagtcttttcaaatacagtatggccaatattgaattactctttctctaacagtcttttaattttggctaatgacaaatcaatgtttccagttactcaagctgtatcttaatacctattcttaacttctatctccccttctatatccaattcattaacaaatcatgtagtttttaaccaccaaaatataaccagattgaaatgacttctcattatttctggaaagatcactccaggcctagaatgtgctgacagagcatatcaacaactctccataatttttcccaggcttcttccacagaccattttcaatgcagcatccaggattatcctttgttaaatttggttgattatgtcactgctatactcaaatttttaactgtacctaatttcgtgcagagtaattatatctatccctctcctattactgaatgatttcatctctactactgtctgtttcttttactttactctgtaaggaggagtatttttcttcttccttaaacatatcaggtgtgtctaaacttcggggtcttacctttgcacctgaaatacttttcctcagatacaaccatggctcatcctctcaccttattcaactatttgctgtaaggtcactttctttgtgaaataatcactatcaaattgtattttcccatgcacttcctctctagctttccttctttcattttccccataacatcttctaaaattccacataactcacatatattttgttaattttcttctctattagaatggaaccttcataaaagcagaaattttgtcttttttatttactattatatcctagcatttttagttgtgacaccataagaagttaatatttacttgtcatttggtccttgcaaagttataagccttaatgattacattataatgagaaaaatgaatgaaagaattttggaaaaatgaaaaaggaaggtattaagtggacacaggtctctccctgctcctgttttcactgggaggcaggaaaatgcacacctcaggaggggagggcatgggacattctggcttctccctgatttattagactgcaaggataaactaagtccaggaaactcagtcagagctctgttctgtatatgcacattcttcctcagtatcataaagggccttcctttgtacttcctatgactgggagcctaactttaatatactgaaggaagtacagcatttcaattgtatctggtacttgaagcaactgaatttacagtaaaacaaaacaaaacaaacaaaaaaagaaaccccacatgctttttacctattgtatatactctgtgtgtctctattaattgcttccaaacttgacagagaaaataaagttgtgtgtgtgtgtgtgtgtgtgtgtgtgtgtgtgtgtgtgtgtcctattctacattttcagaatacctgtcctaggttaaacacattccaaaagactgttagggaacagtttgttctgggcacactgatataaatatttcagttatctttatttataattattaaaaaatttgctatcaccttcatgaatattggacatgaatattcattgctaacatgaatggctcaagataaaggaggttatatgaataaactatatgaaaccaggaaggcttttgtcatctggaatgatgctgaaaagatgattccataagtatgaatttagcccaattattcttagtttttattgcccaatactaactgtaacattaccctgagagctgtctctagaatagtgtttggtttgcctaaattgaacttaaagaaaaatgttgtcaggcctctgaaaggacaaatcttacttgctaataaatatactgtgcatagtagtatttggcctgagacaaacttttccaacctttctatgaaggttgtgacagagaatcctagccctcttttactactacttattcgtggctattgatacttagaatctaattattgtggaaagacaattggctttggtcagtttacagccctcaacatttaatgacaaaccaaatagaaaaaaatcagaatcaacatttctgtcattaaaaaaatttcttcatgatacagctcttgtccagatttatataaatagaagtttatttgttctttgttttagaactatgaaaaactggacacctacgaagcaatttacttaaactcttagaatttagttcaaggttttctcaaagctttcctcagagcctactcacttttctaactagttagatttctcagccttcactagataaaaaccagatatgtaaaataataaagttatccggacacaggcaaacagtgaatgaaatcagtacacagtgaatggcttgacagctgtgagagaagtagacagaaagtgcaccttaaaaacaatagacacaggctgggcgcagtggctcacgcctgtaatgccagcactttgggaggccaaggcaggcagatcacgaggtcgggagatcgagaccatcctggctaacatggtgaaaccccatctctactaaaaatacaaaaaattagctaggcatggtggtgggcgcctgtagtcccagctactcgggaggctgaggcaggagaatgtatgaacccaggaggaggagcttgcagtgagccaagatcactccactgcactccaacctcagcgacagagcgagactccatctcaaaaaaaaaaaaaaaatatatatatatatatataaaacaaaaaacaaaaaaacagataaaacaagcatagttatcaaagatcaattgtccattaagccccacacatcacagcactacttatagataaaaatatgtaatccaatttaggaactattaatcacacaatattctgaattaaatagacaaaaacaaagcattaatttgatgcccattataaacaatatatgtactgctagaaatgagaaataatataaaactattcaatatagcccctaccttgagaaaatattaatctttgtgaaataaacattgagaaatagtgttcactatatgctggttaactgtgcatttgtaaaagtaatccaggtctagtatctacaagattaagaacctagtcttaattctctcacttttagccacctagggtctagggaactagcatgtatccctagacatctattctaaatcataaaatgaaataaaaaatacttcaagcatctactttatgtagtagatatagaatcagatgaggtaatagatatttaatacacttcagaattccattcaaatagaaggtattgctcagtggtcgggcatggtggctcatgactgtaatcccagcactttgggagcccaaggcgggcagatcacgatgtcaggagtttgagaccagcctgaccaacatggtgaaacctgtcactactaaaaacacaaaaatttgccgggcgtagtggtgtgcatttgtaatcccagctactcaggaggctgaggcaggagaatcgcttgaacccgggaggcagaggttacagtcagccaagatcacatcattgcactccagcctgagtgacagagcaagactccgtctcaaaaaaaaaaaaaagtattgctcaataaattaatttaatagttaaaatcttaggctttggagtgaaaagaaataggaatgaaatgggactctttcacttataagccacatcctctttgagcaagatttaaggtatttatatctcagtgacatcattctgatactcagataaaatggcacaaggctgtcatgatgatagaatgaaagagttcatatctagaattcagcatagtgcttagcatgcatttactaaactcttactattgatgttaatatttagaaagaagaatgcacaatagaattcaggcaaaaaaaatcgatttgtaaagcagtgtttcttaaagagactacaactctgttatcaataaaactctcacttctggaatactcagcaacatatagtaagtgatatgataccatattagcagagatagtacatcaaattcccggcaaccacttaaggtggggggggatttttttttttcctattcttagatacaaaaattttcatctgcaaggttacatgtatactttaagcactgcttgctcttcatgtccactttatatactgataaacagaaagaaagatctccagttaaggtctgaaaatgtgtctaagataggtagatattggttgatatggcttgtctgtgtccccacccaaatctcgtctttaattcccacgtgttgtgggagagacctggtaggagacaattgaatcctgggggcaggtcattcccatggctattcttgtgatagcaaataagtctcatgaaatctgatggtttgaaaaatggtagtttccctgccccagttctctccacttctctgccgccatgtgagacatgcctttcaccttccaccatgattgtgaagcctccccagctacatgaactgtaagtccaattgaacctctttcttttgtaaattgcccagtctctggtatgtctttatcagcagcttgaaaatggactaatacattggtcaactatattggcagtggatggtggggaggggaacataaataaatgtttataaacctggccatcaacactttgagctaaaaaaatgacaaatgagtgaaatacacaattcacaactaatacttagcatgtattattttgagcaaattaatagatcaaacactaacataaccccttagtatattttcagttgatacatatatcaaaaagtaaaaataagcaggattggagcatacagcagagacacttctccaatgacaaagtgaggagctacactgaccatctcccagtaaaacaatcacaactgctaaaaaagaaaccttaaaaattaaagtctcagctaggcgcagtggctcatgcctgttatcccagagttttgggagactgagaccagaagattatatgtggataggagtttaaaaacagcgtgggcaacatggtgaaactcatctataccaagaaaaaaaaagataagaaaattagctgtgtgtggtgttgtgcaactgtagtctcagctacttgggaggctgaggtgggaggataacttgagccctggaggtggaggctgcagtgagccatgaccacaccactacactccagcctgggcaacagagtgagaccttgtctcaaaataatattaataatcataatagtaatataaataaagttttaaaatagtctctaaatactgttctaaagacatatggcaagtggaaaaaatatttattcaataaaacctactaaatctcactaagaattgtgaaaactgttcttagtgagttcactaagaacagcctgtctttctccctttccaaaaacctattcagcacagcataatgcaggcatagtcaagaacatgggaattcttcctcacagcttcagtctgaaactaggctatctgcccatgaaggcaggccacacaatttcttatcacccccagcaatgtgctgcagtggctgagaagtctgatgtttccggtgggccttatggacaggaatggagaaaaaggcatttgccaagtcaatggctgtatatcaggtaccaggagatgtgttaatttgctcaagcaatgaaaccacatctggtacggaagctgcaattggagtcaccacttcattaagcttacaatagtccactgtcattctccaagatccatctgttttatgctcaggccaaataggagagttgaacagggatgtggtgattaccacccctgtagctttcaagtccttcatagtggcattaatctctgcaaaccatccagggatgtgatactgtttttgatttactatttttctaggtagaagaagctctaatggcttccatttggcctttcctaccataagagccctccagtcagggagccaatgtgggggttctgccagcttctaagtatgcctatgccaattattcattccagcactggggaaatgaccacagcatgagtccaaggacccactggataaccactataagacagatccgagctgaaaccccattaattatctgacctctataagcccctactttaactagaggaccacagttttgggtccccaagaatcaacgtcagctcagagccagtgtccagcagtccccaaaatgactgataatttccctttccccagtgcacagtgaccttggtaaaaggcccgaggcctccttggagaaggatggaagaaagattaacagcataaattggtgggtagtgtaatgggattcttcctcaaggggacctggcctccccttcattcaaggagttctgggtctgtaaactggctcaactctggaaattgactgaggggtcatgattctctgtttttataattcaaattagtcttttgtccattctacatagaagttttctgcttaaattaagtaggaatgcagtaggcttcctattaatttcacttctaggaacaccctgattaattagccaatgtcagagccttacatgagtcagactactctgatgctgctttgcctctgctgtccattatggtaactacacccaccttgcctttgatggttgagcgccaccacttggcccatgccaccttgggatccaattactcctattgtatttaaattttgtagttgagtgactgtggttcacactgtttgatctgacatacagagaagagcaattatagggctcttcaaagatgcaggtgctgccctcataaatctcttttgcaaagcactggtcaagggtatatcttcaggacccacccagcagggatgagtaggtctaaagtgactagtccactccaccatcccaaactccctaagcctttagatccctttctctgcattaaaccaagagagatccggcatttccagcaagctcagagttggctctcttttaatccatattttagctaaccagacaaataaattattataacctttttttaactcctgaagctgcaacattaaatgcagaatccctacttggtgggcccagatcaataaattcagcctgattgaactctatgtttcttccaccattatcccatacccataatatccattcccatgcctgttctccagatttctgcttatataaattaaaaaaacataacaaaacaaaataaactcgagcagttcttttcaagtgtagcacacttcctcatgggtcacactctgaacttacctctaggggcccacaaggactttagtctagttatagattcagaagcaaacaggagtgttggggctggctcctgaggagaatcaacattatttttcctggcaactgccttaggggaggccatcactgttgcttcaggcagtgcaaggtttctctcctcagacaaaagtggaaaggctgatggcagcatggattagagagaggaggtttccacgactaggaatggagaagccatttcttctgacaaaaaagtttcatcagagtttacaagctcagtgtccccagccttatcagggtcctcccacacatccccattccaagttgcagggtcccattcttttccaatcaatgccctcactttaacaggggacacctggcgaggctgtgattacacctgttgttgcaggtcagccactagcatgataagagtttgtgtctgattttccacaattttagctctttctctacaggagctaagactctcactcgggaaaatcttagcagatttgaggctcagtatctgcttctgaagccaggagttagaatccctgagttcagccgggcgcggtagctcacgcctgtaatcccaacactttgggaggccaaggcaggcagattacgaggtcaggagatcgagaccatcctggttgatacagtgaaaccccgtctctactaaaaatacaaaaaattagctgggcgtggtggcgggcgcctgtagtcccagctactcaggaggctgaggcaggagaacggcatgaacccaggaggtggagcttgcagagagccaagatcgcgccactgcactccagcctggctgagagagtgagactctgcctcaacaacaacaaaaaaaaaaaaaaaaaaaaaaaagaatccctgagttcatccttttctttcatcactttgtccagtaaacttaggagcaaccaaccaacttcatagtcaaaggtattatgtatagagtcactaaactctttgcctctcacaagtggtgaatcaggagtgtcaaatgcatttattttgcataactgtctaaataattcagagcaaggactatcattgttcaccatactattagaagtaaagtacttagcattttttgatctaatcatattaaacagccaactccagaaaccccaaaaccaatgaaagaactccatccttaatattcagttcctctagaaccactcctggcaccaaaatctgtattagtcagagttctctagagggacagaactaacaagagatatagatatagatatagacatatagatggagatatatatatatatatatatatatatatatatatatatatacacacacacatacatatatatacacacacacacacacatacacaaaactaataggatatatttaggagtttattaagtagtattaactcacacaatcatgaggtttcacaataggctgtctgcaagctgaggagcaaggaattcagtctgagtcccaaagctgaagaacttagagtccaatgttcaagggcaggaagcatccagcacaggagaaagatgtaggctgtaaggctaagccagtctagtcttttcacatttttctgcctgctttattttctgattagatggtgcccacccagattaagggtgggtctgcctttcctagcccactaactcaaatgttaatcacctttggaaacaccctcacagacacacccaggatcaatactttgcatctttcaatccaattaagttgacactcagtattaaccatcacagtatcatataacacagcaattccattcttaggtttctgctcaagagaaatgaaaacttatgttcacacacaaaaatatatgtaaatattaatagcagtattattcataatagtcaaaaattagagacaatccccatgaccgtcagctgatgaatgtataaagtgtagtatatgcagacaattgcacattattgagaaataaaaaataatgaaatatcaatatatgctagaccatgggcattaaaacgttaaactaagcaaaagtaaccagatacaatagatcacacattgcatgattacatctaaacaacatgtcagaatagacaaatttaaagacacagaaagcagactggtagttgcctaggactggtgactctggagtaaatgaggagtataggctttttttatggtgtgatacaaatattctaaaattgactgtggtgatggttgaacaactacgtgaatatatactaaaaacattaaattgtgtactttaaattggtagattttagggtaaatgaattatatcttaatatagctgctaataacaagcaagaattattccacagagatgatggagttagcacagcttccttgctgtccacactcagtagcaatctatttgttttcctggagctaatgagcttcttgtggcttacagacagggaccagagagaaacacagaaagtgtcaggtcatgggatgtcttaacacacaggtatcttcctaagggaaatgttaacataggtggatcctataggagtgagtctggtctttataaagcccaaaatcaagaaacagctaaatagaatggatatggaaagcattcctcctgttactgaagccacaaaagtataacgagcataaaaaacagacttgcttcaagtggtataggattagacaattaggttcgtacaatatgaagtgtggatccacacacataagaaaatttcacacacaaaaaagagagttgacagtacaactagttaggaaaaagcaaagtccttcatatatgatgctgtttggtgtttattcagacagaagaaattgaaattgatttcaaatttcattatatacacaaaaatacatgttatatagcttgaaggcttaagtgtaaaaaataaacagttaaaacattggaagattattttgtcaaatacacatataatccaggtcaagagatcagtttattcaagaaatattgaatctggtgatatgaagatatatttgactctatgaacttggataccttgcctatcttccttccttcttccttctttctcatctatctcagctgtctatctcctagaaccagtaaccaaatgtttatacatggtattaattttcacgtattaatattttattaatagaatcaatagcattgatagaattttctattttgttatgttctgttctcttatatactacttgatttcattaacaagagataatattaacaccaaaaattgattttgtgatccaaagtatggcttgaaaatctgctgtagagactttgaatgtttgcatctctttagtgtcataaatatatgtatgcttcctgacttcttccttcctgattttcttcttgaataagtaatttcataaaccattacaacgcttagtatgataaccgtttgctcctattgcgggtatgggctgtggtctggtagagagaatcagaaccccagagggggaggaacatgcagtagtatttgtggcagcaacgtgcacagcaggaagtattagagccttagtcaaatgagaaaggcatctgagagggtgggaggcaaatgtggccatgtttggaagatgaaatgttttggggagccaaatggactggcagtgaagggccagcaagaattgttaagagtctaatgagggtgagtagggcatgcccatgaagtgggggacagcagcagtgtaatttggggtgtcctagactgagtgatatcaggctatctgggctgggtggggtgttgtggaagtgatcaatgtaaagaatcagagcctgggtggggtttcagaaagtaaacggtgtcaaaaccttggaaaagggttgccacagcagcctggcatggggtcatcaaacccaagagaggaaaaggaggtcattcaagatgtctggaatgggaggtcagaacccaaagcaggtaagcagaatgtttaggactgggtcagaatgggaatgatgatttggtgtgatttcaaagcccaaagatggttacaagggcatttgtgtagactctcatatgtgttgagttagggaataatgagggtaatcatggtgtctgcatgggaagggtgtcagtaggacagcagtctacagtgggatgtcaaagcaagagtggagagagtggagcaagatggtcccccagtaatcatcccctgaaacaaacaactttcataacaagaaaatgtcaggtgagcactcacagtacctggctgtaaatacatatcactgaaagagtcactgatgaggataggaaagaaagtcttgaattgctgatgccacccctcccccatcccctggcagaagacacatggcaagaagagaggatctgtgcacttgagagagggagagtgcagcaattgtgaggctttgcattgaactcagcactgttctgtcacagcagaaagcaaaaccagaatgaattcagctgatgccggctcacagaaggagtatataaaccaatcctatccagaggagaataacccaaaccagcagttgaaacttaagttccagccagccttcccaccacaggctaaagggctctggggttctaggtaaacttgaaatgcagtctaggccacaaagactgcaactcctatgcaagtactagtgctgagctgggcttagacccactggactaggatggcatgtgacctacggtgacaatggctggagcagctaagggagtgcttgtgcaacccctccctcaaccccaggcagcacaactcacaggtcagggggatactctttacttctgctgaggagagaagagggaattgtaaagggaacattgtcttacatcttgaataccaggtaagccacagtaggataggacactagtcagtcatgaggctcccatttcaggttctacctcatggctgacatttctagacacatcctgggcaaaaatagaaacctctgccttgaagagaagaacccagtcctggtaggacccatcaactgacgcaacaaacaaacaaacaaacaaataaacaaaaaaccttggtccctgaataaccagcagtgatacccaggtagtacactgtggtgagatttatgagacttgctggcttcagatgagactcagtccagctgtggtggctatgggagagactccttctgcttgagaaaactcttgcatgctgttcgtataaatgtaaatcagtacaactactattggcaacagtatttgaaattcctcacaaaactataaatagaagcatcatatgatccagaaatctcacttctaggtataaacacagaaggatgaaaatcaaaatatggcagagctatctgcactccgtgtttattgcagcactattcacaatggccaatatttggaagcaaaataagctcaataaatggtcctgggaaaactggatatccatacactgaagaataaaactagacacttatctcccagtatataaaagaaaatcaaaggcatcaaactctgaatctgtcatggtaaattgtgtatgcatccacaatggagcattattcagccataaaaagtgacattctgtcattttcaaaaacatgattgatctggacatcatcaaattaagggaaataagaaaattaagggaaataagccaggcacagaaagacaaactttgcatgatctcatttattcatgtgagctgaaaaataaaactattgaattcatgaagatagagagtagagggatggttcccaaaggcagggaagcgtaatgcaggtttatgggggaagtggggatagttaatgggtacaaaacatagttaaaaagaatgaataagacttagtatttgttaggacaacaaagtgactacagtaaaaagcaatttaattgtatgtgttaaataacaaaaatagtataatcagtttttttgtaacataaaggatagatgcttgaggtgatggataccccattatcctgatgtgactattatgcactgcattcctgtatcaaaatatctcaatatcaccccaaaatatatgtacccacaaaaattaaaaatgaaagaaaatttaaaaatacaagtacaagtggaatgaagaaggcaatagtttggggtatggtatttgtggcatgtagtgtgaagtgttggactttgaacttggtaataagtttgtctgcgtggttgtcggtggggtgagggctgcatctgtgctgcgccagtggcagccaggcgtgtggtgtcaaagcatgagtggagtgaggagaccatttgtatggggtcataggcaggagattggtttaacccagtgacatttacttagtacataaatacaatgaaggtaagaagcaggtttcctatcagagaatagagacaaaagtgtggaaagattaaaaaaaaaaaaaaaactagagtaaatggtatgggatcagattggaattgaagttttagtgtgaactcataggtatatatataagtaaacaaaggaaaaataagtataaacaggtctttttagcctgctatttggggcattacactgtgaatttttcatctttactcatgaagacagcttctgattccaaatcactcagcacacagtggttaaattaggacaactgtagcagcaatcaagttttgctgtgctttctaaccatttatttatcaaaatccgaatgaactacctttattttggaggagggaggtaaggaatggctcagtccacttctattgctagataattgtgtctttgtgtctgaaatttatgttttttaacctggagctttctttaaaaaaagctttgttcttatgtgtgggtgagacaagtgtatgactgggaaaatcagagacgaagatgacattttttcccttattttcttttaaaaactggttttggatttaatgaatctatggtttttaaaaaagtatttgaaaccacgagacatataattgaatttttcagttttcttaataactcttccaatgtaaatattctttacttttcaatttaaaatacattgttttcttagctccaaatcaactaattcttggtagttaagtatagaaacaccatagggactttgcaggatcagttgagtctcccattgttctcactagacaactgatacttattagcagtttattgagtatacttcactaacatggtttttgttcctttctatttatcaaaatctcagaaaaattacagcctttatatacttacactttaatcaacaatagctgacagcatgtgaagcaataaatagcttcaagacatgcaataaactctgaggtttatttacaaaacaacacagtgagaatcatttattgccaagttactaaaggtaatagtgattactgctattaaaataccagaagctattaaatagttgcccaagcaaatagtctacattcaaacccagaattcaaattagtcttttttcatttaactttagaaaaacagaatagtttaactctgttcaattagaaaggaaaaaaaaaataaccaagaaacaacaaaaattctccaattcaaacaggtttagaaattgtaagcttttctttgggtcatacaatgggcttttggcctgaagcaaatggaagttttcactttctactatagtcataaacttttgctgataggtcatttataagaaggaatgaataaaagtaggtctctaccatttccataaagatagactaacagagaacatgcagtatcagttgattatcacttaggaaactggaaagagtgtttcttggctttaaaagagacatgatagaaatctaaaagcacagcagataatagggaataaaggtctatttgaagtgtctcttccccagaactccaaaatacacctttattatgacatataattccctagtgattgcctataaaattctattaaagataaagatcttggccaggcgtggtggctcacgcctgtagtcccagcagtttgggaggccaaggcaggtagatcacttgaggtcaggagttcaagaccatcctgcccaacatagtgaaaccccatctctaccaaaaatacaaaaaaaaaaaaaaacaaaacttagcttagcgtggtggtgggcgcctgtaatcccagctactcgggaggctgaagcaggagaatcacttgaacccaggaggtggaggttgcagtgagtcgagatcatggctactgcactccactgagtgacagagtgagactctgtctcaaaataaataaataaataaataaaataaagatcttctattctacctcattcctctggcgaccatattcctctaagtcggggttcctcagtttggtaccaatgacatttttgaactggaaaattctttgttggagaggggatttcctgtgcatttagggtgttcagtagcatctctgacctctatcccttagttgtcagtatgatctagtccccagtcatgataaacaaaaatgtctgcagatattgccagttgtctccaggtggggggtgggggcaaaattgtatctgacagagatccattgcttttatcaatctcaaaatgcattatctgtcatagagtccaattaaaacaacacatagtttttgaaattgagactatctcataaaagctgagacatatgcttcctgaagtcagagttattgtaaccaaccacttgttactcatctcaaaacacattcactgatttctacagtcctcccctgctctgaggatttggttttcaggcaggtggagacataaatactatttaatttctaatgcatcatttcccatgtctctcaaaatgttcccaatagaggtcacacatttttacatataagaaaaaaattcagagtgaaaatccacacaattttaaataataatatatttaaagctaatctaaactcacaataatcttggggatatgaaacctggggtaacagttcattacagttcaagaagtctcatggatgtttgaaacttcaaaggagagcactattgctgattagttacgtagactgaagttttcagtctcttgagaaaagtttggtatttcaaatctgaaaatgatttaagcttactggggaatgaaataaactgcaaaacctttctagcactctaaatcctgatatcacagagattacatctgatattagcatattttgtggtgcctaaagcagttttaggagctgacaattgccagggaaaaagagaatttccgggaagtttggtcctaggaactggacatgtgtaggcatttctccaaattcaaattcaaatatgtataacaataacaataggcatttgtataatagtgtacatataaaacaaatttatagttgaggggatatattttattatatttgtagtacagaggcagatactatattaccgaagatgttttgtttactccagataaacaataactaattcagcacgtttaagcattcatcttgactctcctcactttccaactctacatcattctctgaggcagcaaaacatgtacactcagtggcctcactacagcagtctctccatcttagaacagtgtgaatgtgctctgggcaatatctgtagtgtgaagaaatgtggcttgagtttgttaatttgtaccgtgtcctcatatgcacactttctcaaagggagagtcccagagtccccataacagtcttttaaataaatcttgttctttatactgtgttctgcacttctctaccggtccttctcccaacacagacacacacacacacacacacgcacatcttaatttagaaagaatagcaatcattatttgtaaagacaactgttgggacagcaacaattctctggagaaaagtctaaaacatatcttcttaaaatgtattcctttactattaattatatttgtattagtttttttcacactgctattaaagaccccaaactgtgtaatttataaagaaaaaaaggcctccacatggctatggaggcctcacaatcatggtggaaggcagaggaggagaaaggcatgtcttacacagtggcaggcaagagagagagcatgtgcaggggaatttccctttataaaaccatcagatcttgtgagatttattcactatcatgagaatggcataggaaaatctcgcccacatgattccattacctgccacctggtccctcccacaacacgtggggattattacaattcaaggtgagatttgggtggggacacaaaaccaaaccatatcaatattctgtctgctttttaaatatttttttattttttgaatttctatagtgtatttattatacttcatcacttgggtttctttttattttagaaaaccctgaatccgccatttcctagatgtcatctcaaggctacataacactaagtcctcattacagagttagtaaaaaacaagatggttatcataactgtcttcattacagaggctgcttgaaaatgaagtctacacagagctaaccaataagaagacagtagaaagcaacacaccaaggcaccatttgaaacctcagttgcagcctttcttaaaatcagatccacatgatagtcaacaattttttattgattacatagtatattccaggcactgttgtagttactagggatataatagcaaataaaacaaactctcggtgattatggacctaatataatacttggcatgacaatataacacaaaataagcacaagtgcatataggattacagcaaagaggataaagttaacagaaagcacagcatgttggaatattattattttttataaggtgggtaggtaagaccacttcactccaaggaaatgtaagcaaagtctgcaggaagggaaaaactaagtcatgagaatatctgaacaaggagcctttcaggtagtggaaatagcaagtgaacggttccagaggtaggaatcactcagtgttccaggaggtcagtaaggctagagtggaatcagtgaaaggatgagaagtaggagatgaggtcaggtagctatcagtacaacatttgtttttatcttaggtaatctgagaagccatgtcaggaatttaacaaaaatgtgaagtcattttaggtaatttttttaaaaagtattattctgttgcctgcaactgaccacaaaagggcagggcggtgggctggagcagtccagtagggaagctattgcaataatctaagtaggaggtaggtgatggtggctaggattagggtgaaagcagtgggaatggtgagaaattgtagaatcatgtaaatatctttggaccaaccaaatttattgattcattggtgacaagggggcctgtggataaagagaaaggtcagggttcacttaaagggttttggcccaagaatttggaaggataaagttgccatttactgggtagggaaaatgcagaaggaccacctgttttcattaagataatggaaagtaagtgtcaagcattgagcatgggaaatactaattttgagatgctctgataaaaaacaccatgatatgcttcacacatcctccttcaaggaatgacgggattattcccttatacattagaaatgttgcacactgaaaggcttcagctatcagtcctattcagagaatgcctcatctgaggaaagcccaaggtcaagcagctttctgaggcaacctgcgtctaatgaatattgatgcagacatataaacagcctatctccttgtcacagccttacaaccctgaaggaccatatcacatccataattttccctgtaggcagctgaaagctttacttggactgcactgaagtttaacttctccatacatacaatactgctttcttcccctcccttcaataggagttgataccccaaacactccctaataaagatcctgtaattgaatcttaatttcaaagtctgcttcccagaaaacccaacctacaaaagatgtttctttagtaaccaaagggaaatactgttgttacagattgacatggatctatagttttgagacagagagctaaactagacatttgaattagaagttatgagcatataccacttaaactcattagatctgttgaaataatctttggagtgaatggaaataggaaaagaagaggttaaagttgaaagaagggtgtttcaatttttaaaagtcagggaagttaaggggaagaagtatcaaagaaaacaaaaatagagcagcctgggagtatggaaaaagtcccaggagattggggtacactgtaggtcaactaattaaatttttaaataaagaagaaactatcaattctgtcacatcatgaggatgggttgagtaagatgagaaattaagttgtcaatggaatgggcactgaaaatgcaaaaaaaaaaaaaaaaagccatttgagtggattaatgtgactgaaatcctggttacaatggagtcaacagataatcctggaaaggagaataaccacaactttcttcaggccagtataaacaatatatttgagaagtttccacagtgaagggaagcacagaaatggataaattgctagaaggtttacgggaccaagagaaattttgttgttgttgctttgtgttcaattgcaagatataatggcagtattgcatgctgatggaaatgatcaggtagagcaatggatgcttatgatgtaagaagcacatagggaaattatgaagcaacatccttcagagtagacatacatggaatcagtagaattcaatcagatcagagtcagagtaaagagcccacaattagaaggtgtgtgttttagatttgcattgggccttgccaattacatttccagtcctaagtgctagtgaggtccaataaccagtgtcattctgcaaagtgattatggatcatgatgagacattaaatactgagttgtgtttagaaaattttaaagtgatttgacagtaattttatatatgttgaatctaacagttaaaatggctttcattttacatcttttgtatttcatttttctagtaattcatttaaatgcaccctttataacagaaactttaagaagcactgatctagcatgcaagtgaaagaaatggtttatacagaaatgaggagtgcttatttttaattactgaagtacaagtatcacaggagctttggtgttgcttcgccagctggaaacttctgcggccaatggcaccttctacctgaggattgcctgtgactgctgggcttgttccacctatgcagcctgacaagctgtgctcggtttgtgctactggcccagatcccacatctgccaagtgtgagccaaaagcagagtggcaaaggggtgtgaaggtgagtgaatgtggggtccagtcactgagcacagccaggcacactggctgctacaagagggcaggcagctccaggtgccagtataggaggaaggtccatgtaagcctgtggttggaccagatgcaggcacctgcatctggatgaggggaatatggtggcttgtggaagcttggagatgccaggaactgcagaaccccaaggagggtgtcacagccctggtttggggagcccttagatctgggttccataaagggccacagctcttctctccttcctgttgtctgcattgtggtgtcggggatggggtgcctgtttccgtcctgtttgtgttacagctcttcttttagtcctgcccaaccagcaggtcctgagtttttttcctacatctaggaagaatgaggtacatagacaaatggagggtgagcaaggcagagaggagtttcactgagtggcagaacagttctcaggagacccaaagtgtgtagctcctttcctcaggcaggtagtcccaggtccagcttgtcagtggagaggagatccacagtgggtggctcccttctgcaggaaggtcatctcattgtctgtgaagccctcgtggagaggagacccagggtgggtagctcctatctgcaggcaagttgttatgtcatttgctggagtctggctgagtctgggggttttaatgggcctcataggggaggaagtacatgctgattggtccatgggcagccaggggcaggcccaaaagcagcaccctaaattctcattctgatctgccgaactgacagctgggcccccaggctattactataaagctaccaatgtcattattcatagaactagaaaatactattccaaacttaagtggcagtgaaaaagagcccaaatagtcaaagcaatcttaagccaaagaacaaagctgaagccatcacactacctgcattcaaattatactacaagtctacagtaaccaaaacaacatgctactggtagaaaaacaaacccatatactaatggaatatattggagaacacataaataaagccacacatctgcagccatctgatcattgacaaagtacacaaaaataggcaatgaggaaaaactccctattaaatcagctggctagccatacatagaagaatgaaactggattcctagttttcatcatataaaaaaaagtaacccggctgggtgtggtggctcacgcctgtaatcccagcactttgagaggccaaggagggcggatcacgaggtcaggagatggagaccgtcctggctaacacagtgaaaccccgtctctactaaaaatacaaaaaattagccaggcgtggtggcaggtgcctgtagttccagctacttgggaggctgagtcaggagaatggcatgaacccaggaggcagaactggcagtgagtcgagattgtgccactgcactctagcctgggcaacagagtgagactctgtgtcaaaaataaataaataaataaatattaaaaaaaataaattaacccaagatacattaaatacttaaactaaaaactaaaactataattcctagaagaaaacctaggaaagttttatttttatttttttttgtcaaaatgatgaattagagactttggtgcgcctcagccacttgaaaatagcaaaataaatcataaaaatgaactctgtgaactttaagaagaaaaacgggaatccaatggaattatgaagaataccccagatcctggagaggaaaacaccagcaaacagctcccacgatggtgtccagttgataaaaagaaagaaagaacaaagaaaatatcccacctgcatgaaaaagttacagaaattaaaaatcctagtgtctccagataagaaaacatcagtgcaagaattctggcatcatgaaaatctgaatgtagtgataccaccaaaggattccactagattttaagcaatggtccctaaccaaaatggaaactcagaaatgacagataaataatataaaacatggattgcaaaaaaattcaataagatccaaaacaaacttgaaaattaacacacaaaaaaattctaaagcaattcaggaattaaagaaaaagataaacgtcttaaaaagtaatcaattacagcttctggaatcaaaaaaactcttgaaaaatgttaaaatatatcaaaagctttattaatagactggatctatcagataaaagaatttaagagcttgaagataagccttctgaagtaacccagtcagacaaaaataaagaaaaaagaattttttaaaatgtacaatgtcttcaagaaataaaggattatgtaaaacaatcaaacctattaattattggcatttctgagagagaaagagaaaaagaaaacaacctggaaattacatttgagggaaaaattcaagaaaatttccctgatcttgccagaaaggtagacatccagaaacaagaaatcaagagaacatctgtgagatactatataaaatgacttcactagggcatacagccacgtgactgtccaacatcaatacttaagaaaatttttttttttagcagtaagctcaaaatagcgaatttcattgtttttttaaattattattattatactttaagttctgggatacatgtgcagaacatgcaggtttgttacataggtatacatgtgccatggtggtttgctgcactcatccacccgcgatctacattaggtatatctcctaatgttatccctcccctagctccccactccctgacaggccctggtgtgtgatgttcccctccctgtgtccatgtgttatcattgttcaactcctacttaaaggcagatagagaaaaaggaaagatcacctacaaaggtaaccccatcaggctgaagcagacttctgatcagaagacttacaagccaggggagcctggggatctattttcagcatgcttaaagaaagcaaattccaaccaagaatttcatattccatcaaattaagcatcttaagcaaatgagaagtaaaatattttcctgacaagcacgtactaagaatatttgttaccactagaaagccttcaaagaaatcctaaagtagttctaaacatgggaaccaagaaccatatctgctaccacaaaaacatacttaagtacatagcccacagaccctataaagcaacaacaaaatagaaactacaaagttaccagctaacaacttaatgatagaatcaaaatttcacatatcaatattaacctggtacataaatggcctaaatgccacccttaaaaggcacagagtggcaagttggattaaaaacaaaacaaaaccaagatccatatggctgctgtctccaagagacccaccttatatgtaatgatacatgaagtaaagtaatgatgctcaaagtaaagagatggagtaagatctactatgcaaacagaaaaggaaaagaacagggattactattctcatatcagataaaacagagattaaactaacaacactaaaaacaaaaaagaagaaagaaagaaaggaactacataatgataaagggttcaattcaaaaagaagatttaactatctagaacataaacacaccccacattgtagagtctagattcacaaaaccagtactctagacctatacaaagacttagccacacaataacagtgagggagatcaagaccccactgacagcattaaacagattgtcaaggcagaaaactaacaaagaaattctggacttaaactcaacacttgagcaactggatccaatatgcatctacagaatactccacccatgcaccacagaatatacattcttctcaactgcacagggaatatactccaagatttaccacacgctgagtcataaagcaagtctcagcaaatgaaaaaaaaaaaagaaatcacagcacccatattcttggaccccagtggaatgaaaatagaaagcaataccaataatatttctcaaaaccccatgattacatggaaattaaacagcttgctcctgagtgacttttaagtaaacaacaatatcaagccagaaacataaaaaattatttgaaataaatcaaaacagaaacacaacataaaaaatctctgggatgttgcaaaatcagtgttaagaagaacatttatagtgataaatgcctacctcaaaaagttagaaagatctcaaattaatgatctaacattatactagaggaagtagataaacaagaacaaactaatcccaaagctagaaggaaaataagacaactctaattagagttgaaccaaatgaaattgagacccaaaattccacacaaaggataaatgaaaccatagtttcatagttggttctttgacaggataaacaagatcaatagactgttagttagattaataaagagaagaaaagaaaaattcaagtaggcacaatcagaaatgacaaaagtggtgtaatgtcacagccgatcacacagaaatacaaaactccctcatagacaactatgaacatttctatgcacacatactagaaaatctagaggaaatggaaaaattcctggaaacacacaacctctcaagattgaatcgggaagaaattgaaacactgatgaaaccaatattgagttcaaaaagtgaatcagtaataagaaacctaacaaccaaaaaacagtaataataagccccagtccagatagattaacagctgagttctaccagaggtccaaagaagagctgatagtaattctattaaaactattccaaaaaatcaaggaggggtgattcctaactgattctatgaagccagcatcacctaatatctaaaccgggcaaagacacatacacacacacacacacacacacacacacacagagacagacacacacacacacacaatgaaactactggcccatgcctctgaagaacacagacacaaaaattctcaacaaaatacttacacgtcaaattcaacaacacatcaaatatttaatttacgatgatcaggtagggttaattcctgagattcaaggttgtttcatcatatttcaacatatacaaatcagtaaatgtgatccgatcacatgaacacaatttaaactaaaaccatatgatcacctcgagagacgcggaaaaagctttcaacataattcaacatcccttcatggtaaaatccctcaagaaactaggcatcagaggtacatatctcaaaataataaaagctatctacaacaaacccatagccagcatcatattgaatgatcagaactgcaagcattcctcttggaagtggatcaagacagagagatcttgtctcaccactcctattcaggacaacactggaagtgctagccagatgttaaactttttttttcatatatttgctggaggcaagaggaagaaacaaaagcatccaaatagcaaaaaaaaaagaaaaaaaaatcagactatctgccttcactggtgatatgattttatacctagaaaaccctaaagactctctcaataagttattagaactgatcaacaattttagcaaggtactaggatacaatcaatgaacaaaaatctgtaggagttctatacaccaataactaagagccaaatcaagaacacaattcaatttacaacagccacaaaagaagtaaaatacctaggcataaatctaaccaaggaggtaaaagatctctgcaggaagaactacaaaacactgctaaaaaaaaaaaaaagggaacccttgacaaaaataagcactgtggaaaggactccctattcaataaatggagcttggatagctggtgagctatatgcagaagaatgaaactggatacctaccttttactacatacaaaaattaactcaagatggcttaaatattttaatgtaagaactaaaactataagaatcctagaagaaaacctaggaaacactattctggacatcacctttggcaaaggatttatgattaagtcctcgaaagcaattgcaacaaaaatgatcattgataagttggacctaattaaactaaagagcttctgcacagcaaaagaaaccatcgacagagtgaacagataacctacagaacaggagagaatattcccaaaatacgcatccaacaaatgtcttatattcacaatctacaagtagcttaaagaattaaacaagcaaaaacaaaaaattccatcaaaaaatgagtaaaagacattaataggcacttctcaacagaaagggatacaagtagccaagaaatatatgaaaaaaatgcttaatatcactaatcatcagagaaatgcaagtcaaaaccactatgagatacctactcacaccagtcagggtggctattatttaaaagtaaaacaacaacagatgatgggaggctgcagagaaaatagaatacttatatactcttggtgggaatgtagattagttcagccacagtggaaatcagtttggagatttctcaaagaactaaaaatagaactaccatctgacccagcaatgccacccaaaagaaaataaattgactgaaaagacacaggcacttgtatgctcacagcagtactcttcatgatagcaaggacatggaatcaacctaggtgcccatcggtggtggagcatataaagaaaatgtggcacatatacactacggaatactacatagccctaaaaaaggaaattgtgtccttcttagcaacctggatacagctggaggccatcatcctaattgaattaacacagaaatagaacaacaaatattacatattctcacttataagtgagaactaaatggtgcatacatgtagacataaacttgggaacaaaagacactggggagtactagagggggctggctgagagggagcgtagcaaggctggaaaaaccaactgttgggtgctgtgctaactaccttggtgacaggattaattgtaccccaaacatcagcatcatgtgacatacccatataataaacgtgtacatgtaccctttgaatctaaataaaaacggaaaaataaagaatggcaaaattaaaagaaaaacaaacaatacattttgctaaatgaaataagtcagacacaaaaggacacatgctatatgattccacttatataaggtagctataacagtcaaattaatagagacagaaagttacatggtgggtgccaggagctgtgggctggtgtttggggagttagtgtttactgagtacggagtttcagtttgggaggatgagaaagttctggaaacagacggtgatgatgttgcacaaaaatgtgaatgtacttaatgccaaagatggttataatggtaagtatcgtgttccatatttttattacaactacaataataaaagatatgtaggaatttgccagatgaacaagatgaaaaagggcattgccatgaaataaacataatgaatctgaaaaaaataaaagcatctttgattgcaaaagagcaaattgcaaatatccaaagtaatccttgtaatacacgtgacattataaattttacgatgcagtgcctatgattcacgcacactgtacctgaaccagctgtgaaacattcatgaatcataaactcctgtatcatcttcagagcaaaaatgcatcctattttacaagaaatattcatcaaaaaagggaaagagaagtaaaaaccctgaaatttctagaacctttcaaagatatcagaaaaacaaatcaatacctctgacaggacctgttaattcagagggtcatgctgtaagacagcttgcatttaattcaaactgttttggaacaagatcaattctgtagtgagatcaaggcagcagaaatttttcctcagggctaaaaataataattccttgaggcccagacattaaattccatggcttcttgaaactattcaaaaatgagaagaatggataaagattaaaagaaaacacatgctgcaagctgacaaaacacctttttagacttacacccaattcgttcattagtcaaatgtgtggttttttttttcccttcaggtaactggaggtgtcaacattcaacttcttggtctgtttctcgtcattttctattttctcctgctatttgtctctgagctgttatacctgttattgcagtttccaacaagaaaaagccaggaaaaggaaagagaatcaaagcatcagagcgagtcacctcactgggaggtggaaccagaagttttaaagcagtagcaaaatttgtatgttctgggtgtcagtggacactttctgtataataattttattttacttttgttaagaatcatgaagcaaccacaaaaaattaaatcaaggcttatcaagtagatgtttgaaagagaaacaatgattcaccttataggtagatgtactttgctattgaagggattgtgggcaagtctaagcaaagctgaagggaataaggaaatttcattccttagagaagacagcatagaataatagtacagagagtgtagggtagaacagcttgcattctaatcccacatctgcaacaggattctctttgacataggaaaagttacttctgctttgttgggagtattaaaaatggagaagttttcaagtgcttagtgtagttcctggcttatgatagcatcaattaaaattaggtattgatgctattattattaatattgatctcttagccatctatatcttcagcatccaaagtgtcagtttgttctttaaattgcaattgacccttttttctcaatagaatagctagtaaaataataaagtggaatttcttggaatgtatccattctcctcttttacatttcatttttttattcattatttcaaatgcccagtaccttcttgttcaccctaaaatcttttatgagtttatgagttaacaggaaaacagattccttttagaaaattggaataaaaagaattaccattttttttttttttttgagaccgaatctcgctctgtggcccaggctggtgtgcagtggcatgatctcagctcactgcaagctccgcctcccaggtgcaactgattctcctgcctttgcctcccaagtatctgggattacaagcatgcaccaacacacccaggtaatttttgtatttttagtagagacagggattcaccatattggccagatgggtctgaaactcctgacctaaggtaatccaacccctcagcctctcaaacacttttttctacatttcaaactctttgcaatttacctgctatctcatttaatctcctcttccctacactgaagacaatcaacctccctcctattaaccaaccacttatcctgcctccttatgtaccttaaatacgaaagataagatagtccccattattttaataaatatttattgaatatattcttgacaagtaatcctgcttgtatttttagctagctaatgtgagatacatctttgacatggttaaatgtatgatcccttaattaatttaatataataaactaatgctacattataggggtataaacacttttaaaaatatattttctattttaaagttggctttatacttaacataaatataatggacactttgtttatttttgaatgattatcaatcattcaaaggtcagtacatctgacctttcacaaaaaaagtaaaaggtcaaatgtaaaaattgtaggttttgtggttcacatatagactctgcatattattctttaatttttgtttttggttccatatttttgtttgtttatatgtttcttacaaaccttttaaaatacaaaaaatattctatcttacttgtctctcaaaacataggccatttaacccaggaactgtatttggtcaatctgtgcttcactgtaaatgttctttgttattttaaaagcaatacggacatatttcaagtaaattattgttttcactaccactcattttcagatgtaagtccacaggttaacataaataagaaagtagcagccaaaaacaaaaaaaagagagaacagtaagaaaaacattttaagtcaaaggaaaattgccagcttttatcttctcctaaatcccaatccttcactcctaaaggaacacattaagtgcaaagggggtcatacttttattccattgcaaaaagggtcatacttttattccattccccatgtatacatttgttatccatttggcaaattgtggttgaatttctcttgggatgacctcgccagcagtaggtgaatggatcatttgattcaacactagttcgtaagtgattgttcttttcaatcaggcacacactcactgctgataactgcatattttgactatttgtagaagtgttaaaggaactaagaattttatcgtaaataagccatgttggaacaaatatcaaggccttgagaataatatactttatacctttgctcaacatataatgtaggaaaatatccaattaagagtctagaaatggagtgaggaagggccagctgagtattttgtttaatttttaattgttaactcttatagtaccttcataaagtttccaaatcttttcctttttcttgcttttgctgtaaatacaaaagtccaagcctgcattatattatactcagtttgaataaggaatatcagctccttaagaataaaatgaaacagttttattcttcccaagatcttttcaggcttttatattgatcatcttcatttctgctgtgtagctggcttcatcaatgatgtctcaatttatgtctataattgttattttgcaaaactgtctcattttaattaatatgatgccttactcattatttttaaattattttcttcattattttaaaactaattttatttctaaggactgggaacagggtgggtggatgtgataatctcacacatgttcttgtcttttttccttttattttccctctggtgctgggatagagaggatgaagaaagaaaaatgtattcgttagatgaattatctgtattgaggttgttctaggattactgtgctagaggaaggacccccaataaattccaccattaagaggctcaatatcaagcaacaatcctgtgatctagtggcactgtatggaattctaacgtatcttttagctaatgtccaggtggtagtctgtgttacatcttgatatgcatacctctcttcttcacatgcttcagtatcctttattttatttataattagaagcacaaactctgagatttacggatccaggcaggactgatctcacctacaatactgggcaagatcttcaaggggacagttgatgctttcttgccaactgcccactccaccaccacatttctctccaatgttctctcccttgttttagttgtactgactcaaatctaagcagctatttgattagagtattgaatggtgatcttccctgttttgtgtgaatttctttgggattttcttctctcaatccttgccagactttttttgtaataacactggactagcaacaatttcaacctcacctatttataaaataatgttatctagtactatttgagacctctcttacttggattttttggagtattgtactcagaatcaggaactttttgagataaaatctgagaaatgaataacttttgctcaattgtgctttattcaggttcttatctgtattctattctataatctccaagtgaggaaaatagtcaattcatatttctctaaagtgtttcttcataagagccttaaaataaattgtatatattttaaacattagtacatttaccccaatataacatcacaaaattaacctttggaaaatacagaactaatgtaatacaaaacattcccatccctccaaaaacagataaaataaaatataatagttctctacagcctaatctaaaagaatgtgatgtaatggatagagcactgatttattaatcaaagggagaaaaactaatgtggctcataaacctttccatttctgagtctcattcttttcattttcccgataataatgataataagatcgacctgtttgttagggtcaggttaatgaccaagtgaaatgatgcgttatacatatgtcaaagaaatatagcctcttaaaagaaagttaacgcagctgacattcagtaacatatctcggtttgtaagtaaaaaattagaaataaactcaaataaacgatcaatacatattatagtaaaaagtaataatttgaattaagataacttgttgaacactgatttatcaaactctattgaactaacccattttttaaatttatacttttgtttgtttgttattagaaaaacatttccctagatagaagctgctccactattctgaagggaagtagaaacgatgaaaagcagaactggagatgatccatgatggacatatagtgtgagtaagaaatatatattatttgttttaaatcactgagattttgagtttgtgtatgtgtccataatatgagctaactatccttaatgataccataagtaaagaatttaaagtaaataagatgtgcctgaccgcatattaagtgccacactaagtgttaattatagctccctggcggtaaacaggggactggttccagacttctgagtatataaaaaatccacacatactgaagtcccacagtgggtcttatggaaccctttgtatacaaaaggttggctctccaaataggcaggatttatattatatctctcaaaaaatctgcatataaatggatctgtgcatttcaaacttgggttgtgcaagggtcaactgtgttactattttatgggatgagacggcagagatgatacatggaaattttgtgtttaaaaaaggagaaatatgcaaatggtggtggggtgggccaaatggaatgtgagttacatgaaagggtaatttggaaggaaacaacgcttttgtgaagaaaagaaatacttgaatatttgagtataaaacatagttttatttagtacccttgcctcatctttagtatgataaaaatagataaaaaattcagacagacaaagagggaggaagctgcttgagtgaacatactctgttgatgtaaatactcgaggaaattagctctatattgggtggtgtgctgatgaatgcttaacaaaaaaactttgaagtgaaaggcactgatttgttgtatttgatgatttctgtggcataaatatgcccaccatagcaatgtttagctggtaacatgacatagctgcacagagtcaggaagagatgcacatgactggctctcacgatttcggcgcggtctggctccagcatttgactgtgacaagtttcactggccggtgagaacgctggaggaaaaaaatctacctataactgacccttattagcataacaggtttgagaaagcagagccctattttcctcaagtgaatgccatcaatacagccgtcaggcaaaactgcattcatgcactgaggaaaatcactgcttctcaaacaacttttggataccataaaaggcccgttcttaaaaggggaagtgggaggaggggaaacaagaattgttgcctgaaaagaaacgactttgatctccatcaaaacagattagtttgaagccaatttgctgctatcttcaaaactatatttcccctcaaattctgtcttccaaattgagcagtgcgtcagctgtaggtagtgctagagtgtgaaaaggatgaggatggaggcagccagggtacctccaatgcatcttgttattagaagacttttgaagagtaatttgacgggagcttttcaacttttaggtcactagtttaaatgtagtctcagttgatcatgaacaaaagtgggtggttagtggcctatgaaaagtaccttcatggtattacccttgttctttctaatagagactgccactacagttggcatcctttcttttccttctaccagaagcacaaagggtgaatagaaatgtcatttcaagtattttttcagcctttgtaccagagaaatttgaaatatgaaaaaggccaacttcttttcatctttaactcacaggtagaattattgaactataatatgtttcctagatcttcctggattttattaaaatgaaacctgagccactttacaagtaaaattatgtcttacttcatagaaagttaaattacataaaggcacatacttgacaaatatttaaatataaaatgtataatttcttgacctgaatcttacacatgtaaaatttattttgttttccttttctttctcttatttttttcttgcttcaataaatgagttcccatgaatgtaaagacaaagatcttattactccattaaatgaactatcttaatatttgattttttctattctttatcattacaatactttgacttttttttcctcctaaagagactgtaggttttattccctttcttttaattatttcatgaaaatcctccaaatttccatattactaatatctctaccttcatataattttgtttcaatattaaatgatcaattaaagcaaactttctctaagtacctggagaaaagcaacagaataaatattagagtagagacacaaagtagtacttggtaatgccaagaaaatttcagcagctatcagtaatcagtaggatataacagaaatagccctgttttagaagtgatgaaaactcaatcaactgattttaagcagcagttactttctatggggttagctttccacatctcaaaaataagattgatgtgttatttttgcatcattttcaatacaaacattctatgaaatcttcacttttatatcatccgaatttaagtgacagggtgttaatattcgaatgggatttaagcgagatgtagctgtgccttatgtcacgtcagctgatggtaaagattgatgctgggattttcctgggttagtcatgttaaaatctcccctaggctttaaggccagcttcatgaattctcatatcagcaacttctgcaattaccacataacaccagaagataaactctgttctctgaacattcatatagaaaatagtacgtcatcttatgattcttatgattggcatagcaaagtgaaaatatatcaacaccgtatttagcccaacttgaagctgcatattcagtcaaagatagagcttttcctggccaaagatactttggtcagaaatatataaacagtgaacaccaagctatcatcttgcaagtaacacatatgctcatgaatctctagctacaaataaaaatatcagctaaaactacccccttcttctaaaggaataaaaaccacagcaattacaagatttgcctatggccataaaatgaagtggggtttgtctcagaattagaatgcctaccatcagcctttgagtacaaagttaattcccctacacaagactgcatcaaaaataaatccagctggacaaaaggcatacaagacagaaaataatagtcagctgcagactctttggatccaaagtataaaatattcaagtatgtgtttccaatcccttcattctctcctgtaatgattgcagctaatccctgcctgccaaacgttagttcttcaattgtggcgatcaatagaatagattagctgtggaaaccctccatccatattacccttgctttcctttccagatggaattttcattcactagagtggaggcaagcatgtgaggtttctccctccatacacaaatataaactcattaaatgccaagcttgtcactttagaatttatacacacacacacacacacacaccaaggaacatacctgtagatttaataaaacagcaccaaccctcatggcttcactaatttcaaggctatacatcagctgtgggaagcgaggagggctttgattatttggtggaagcacttcaatatacacagtgcagatggagttcctgcagagaaagagaggaaaagaagatggttacgaatctgcatcacatttaatgttagactgcattgtttattcagttgttgggtttacaggagaaaaaatttccaaattttatgaaaaataatacaatcaaaatgaaaggatagaaaaaactaccaccaaagtataatggttttatgaaattatcttagtaaaagtaattgactccagtatctgtttttcctacttagattaatagtatgaattaaaatggaatagctatacaaataaagctaataaattaacttgccttgacttctgactttgtttttaatgcttctctaatagcaaaatcattctataaacatctggtaataaaagctgtccttggggcttttttgctgttaaaccagcagagggagtattgattacaataactcacaaaacaaattatgggctgcgttttatcagttctgttgctgacatcaatggcttaatgtaagtgcatgtgaggagtcaggatcataaagaatcctacgtaaaatagttgcaaacaaaactaaatacgttttaaaatcttctctaaaaagcaatatatgataagctaggaattagatttaataaagcccttataatgacaggagcttttcttgaaggacaagataccttatcattacaaggaaaaaaaattagcattgacatagtcaacttctttgatatctctgaactttgaatttgttttataaaacaaaaactgaagaagcatgttagtcaaggtttgtaaggtggaaacattagctgaaatatatcaatgagatctgaaaatacataaggttagccctctatcgtgaaaaaacatatatatgtatacatacacacacacacacacacatatatacacatatatacacacacatatacacacacacatacatataacattttgtacaaacataccaccactgcctaagatgtatgctttgaatttaacaaagtcatgatttagttcaaaacacatttgttataatttctatttggggatgagaatctttatttatttatttatttatttatttgagacggagagttgctctccagcccaggctggagtgcagtggcatgatctttgctcattgcaacccccacctcccgggttcaagtgattctcctgcctcagcctcccaagtagctgggattacaggcctgtgtcaaaatatctggctaatttttgtattttcagtggagatgggttgtgccatgttggccaggctggtctcgaactcctgacctcaggtgatccaccctcctcaacctcccaaagtgctgggataacaggtatgagcaccacacctggcctagaatctccttaaagtagtcccaaactctttataagatgcttcaattaaaagacatggtcaccaaaaatatttgtctgagtttattaactacaacattctacttttcaaaaccttttgaaagaaattcaggctgggcacggtggctcacacctgtaatcccagcactttgggaggccgaggcaggtggatcatgcggtcaggagatcgagaccatcctggctaacatggtgaaagccggtctctactaaaaatacaaaaaattagcttggcgtggttgcgggcgcctggggtcccagctacttgggaggctgaggcaggagaatggtgtgaacccaggaggccgagcttgcagtgagccaagattgcgccactgcactccagcctgggcaacagagcaagactccgtctcaaaaaaagaaaaaaaaaaaaaagaaattcagatcataggcactaaaatttcgttttatagcttgtcactttataatatacctaaattcaagttgtttctgagcatatcatcagtagatagataccaatagaatagtaagcataaaagctacagtgacttttaaaaatttcatggttgggtgcggtggctcatgcctgtaatcttagcacttttggaggccaaggtgagcgatcacaaggtcaggagttcaagaccagcatgaccaacatggagaaaccccatctcgactaaaaaacacaaaaattagccaggcatggtggcctgtaatcccagctactcaggagtctgaggcagaagggagaattgcttgaacccgggagacggaggttgtagtgacccgagatcgtgccattgcactccagcctgggtgacagggcgagactctgtctcaaaaaaaaaaaaaaatttcatgcttacatttatcatgatattgttctaaagtaatctcactttaaattaaaatattttaaactttcatagttaaaatatctgtattcatttctgcctctgattttatctatttagtatcaaaatttgccaatacagttaatcagattatatttcttaaatgggttcaaactgatgatgaaatgttgcttatatacttataattattaatgtaaacatgaaacaatgggaagttacaaaatgtattgtatactgcaaagattcccacttccgtgttgtgagaacaaaagaatcgtcattctgaggtagacctaacatccttccaggtggtgatctgactccagaagcagccccaagatgtaaaacattttccctgatattacccttgaagatcttggcttcttttagggtctgttgttgatcaagtttttaaaacattttatgaatctccttcttttctctgatagcacattctctatgcataacaagtcctacaacgttattggtaataaaagtaggtgagtgatgttgaacacagaatttgtaaccagatattcctgagttagaattttgacgctgccctcaatgatctagagcaaattatttctttcagcttcattatttccacataataagtgggaataataataacatctaaggtcagcataaagatgaaataagtttatatatttgtatatgtaagtacatgtatacatatatatgaaacatacttttataacttattttaataaattactcaaaataaggcttaaggtttcttattccactctatgaatagtgcaaacgatcttgcattttccttagctacatcctttataatactgtagatattttaattgaatcctttcacttggctaaattcctacaaaggcttgatactccttcacccctcctgagcatggggtatgttggtgttagaatttgagcatgttgtatcataatctttagggtaggatacaagaatctacaattttcacaaatttccaaagttctacttatagaaactagactttgaagaccactgcttcagaatctcatgaaaagtacaatatgtagactcacctgttttttttaaattacctcaggagaaaaactctacaaagtcacttaacgtcttcaataaccctggatccaagagacttcctcactgtttaacatttttttttttttgacctggaacatatctgtactgcagattcgaagctttctttcaaaagctaggccctttctgcttcgatattctttagatcttcagtttactggtcaagaatactttataaaggttttacaagaatatcagtgtcttaaagcttgtgaaagtatagttaaactacacttattatactttttgtatttctttattcctttccctttcattatcttcccattgtagagggttaaagtgagacaatgctacaataaggaccttaaactcgtatgagttacttggatacttgtcacagagtcgaaaactttaaaatgctgaaacaaagaggactctagtctcagacaaaacacagagacaaattttagcccaacatgaccgtctccttgatccgtccttactcctttgcttcctctgttcctttccacaataattcaaaagctagaattgctaattgtgttcccccacccccttggtcttgaatgttagttatttggaggagatcatatattaaggtcttgtatttttcatcttcaacatcctggcatgtccctataatgtgtttaaataaccaccaggcttcttgagggttactgccttttaaaatgctatctcctttttatccctgatgtcagcacagtgtcagagttagcttttctaaaattaaatacccatagtattaacaataaaataatagtatttatgctgtaataaatagtagtatttcaacagcatcatttaagcacttaataaaatagggcagtcactatataaataacactttacgcaagcattttgtattcatattttatcgctaaatgcataaaactgagcatctatataagaaaaattttatttttgtaatatagccagtatgatgcagataaatctccatttctaaaaacgaatctcataaagctttattatatttcacctggtaataaaggtcaaagtagcacaaaagaggtaatatatttcttatatactcttgaaacctacccaatagttccataaatataaatacatatatacttttttttgataaacatagaaattgacccttctggtcttaaagcttgaaacttaacatttgttttatctgagctccttcctcaggaaacaaccttcaggcctcccaaaaaaggtatcaaagaactgaaactcaccagatcaccacatccgatgagatgccagacccgtcattcattatgattgcttcctagcccctccctagttcctgttttcttacatattgttacatttcttccctgctatgtaaacactaactgtagtcagtcagtgagttggatttgagattgtcaccaatttccttagctgcagcaccagattaaaatcttcttctttgacaattgttgttcagtgattggctttttgtatgaccagctgcagaatctaaactgaacccctggtgttcctgtgacagattttcgttacctgaccaagaacacattgcttgtgtcttggctgccttgagccaagagtcttagaaggcctcctaagcagttgctcacccaattttcactggaggtgttttggtttttttctggccccacagcagctacccccaactacattcctgattgtctagtcagaacagcatttgaaatttgacatctgcacccggataggtgagtgtcaggttctttgtgggcctggacagcatgatcccctcctctcagtttgagaattttttaaagaaatttttatttgtcagttgaacaagcccaaatgactgaaagtgggaagcatcctgtgttagtatggacactttttgggggtttcagtatgaacactcttgggggcttgtttgtaattgtgaggtgtgtgtgtgtgtgagcaagtgtgtatcttttgtgggactagacagtgggattggctcctctcaatttgagaaattcctaaggaatttttctttgtgggttggtcaagcccaaccagtagaaagaagaagcaccccgactgtttcagtttggatgctcttagggctcgtttattgtttcagcagtaggattgtgttggcgattgtgtgtgtttgatatagtcatagcaaagtagaattcagtaagctaatattttctgaaacactgtttggctccaatattctttggaatctggagtttgctattgaatgggaaagcatgacagagttccatgtatccagacttttgtgctactgctctaaccatggtcaggcctggtcagtatgtgatgttctcttgtgatgctgtttggttccagtgttctttggagtctggggaggtttagcctttaaaaagcaaattgccatgaaaactattctacccaaaattttgattcacagccttcaatggattacctactgaggtcaagaaagtgtggctatgtaaaccagtgagtttctattgctatatcatggctataattttgaggtaaaatagattggatctttatgtgtgtttatatgcgtcttaatggtttatgtatgttcatgtattacgtttttttttgtctaccaaattggtttataaataaaagaatacacataagtaagcccaaagtatttttcaagttcaaatgagttaagtcaaccacaataagcaagctggctttaacatttttgataaaataaaaataaaaatgcctttagaattgtcagcatacatttttgctgagttttatatatgtctctgctagatatgattgaggtgtcatggtttggcatagaaggttatagaactataaacccagctaacataaaatgatcttggtttgtgtaccttctttgacaaatgagactaatgtaatgttgttagttgattcttgtgagttaatggcaaaaatacccatatctttaattttaagatttagttgaggacctgacattcatcagctattaaaaaaaaaagtaatgaacaaggaaaaagctaactttaaatgatggtgtctaatatttcagttttcagaagaaatctggataaactattaaaatgaaataatcaagtacttgtaaattgaataaatgttgtaggtacactttttgtgtaatataaaatttttaaattgtttttggtgctcattgggtgtctgggtcatttccaattaagaaaaagttatggggaaacatatttctaaaaattgtggaatggttctcatctgtaaaatgctaatatctgatagtcagctcagaatttcttgcttctcagatgttcactaaagttttgttcactaaaatttaaggctactaagaattctaaagaagatgtgtttttattgagaaaacgaatctgtttgtctagttcagaagttatctaaaggctaattaaaattatgggcttgaaatggttagttatgaaacaaggcagaagaaaaccaataagtagaagaaagagatgtgtaaaaagttatagatacgaaaatatattttaggaaggtgataatgaaaaaaataacaatttttataagaaaagattttgtatggtgaatgtttgtccaaaattaaaataactggttattaaaaaaagaacagaaagaaaatctaagacaaaacaaaagtccaagcatgtcatggatggtctgtgtaagtcatatgccatttttcctgtttctctgtgtgtctatcttcatgcctgtacaaagaaaatacaaagttgaaaaagcttagataataaaatatcctttaaaacttgataaaataggaatgctttggctaattagcattgttcatagttaaagctcatatcttaatgaatgtaaaatataaattattgtaaagaaatacattagcagtttggcaattttttaaatatagttaagcccaaagctggatgtaacatggagccaaatttcatagtatatttgctattctgcatcacatacctaaagtgaatttcttagttacagaaaatgtatagtggtactgctggacttaaagacagtaaatatcaaaaaactgaatcaggaataaaatatccatcaggttaattttttttggctctgggtaacactgtaaagccaaagttaattgagtagaagataaattgagggttggactactgtttatttctgcttttttttttttcttgagacagggtcttgctctgttgccaggatggagtgcagtggagtgatctcagctcactgcaacccctgcctcccgggttcaagtgattccccttcctcagcctcagtcctcagctgggactacaggtgctgccacctcacctggctaattttttgtattttagtagagatggggcttcaccatgttggtcatgatggtctcaatctcctgacctcgtgatccactctccgttgtcaccaggctggagtacagtggcacaatcttggctcactgcaacctccacctcccaggttcaagcaattcccctgcctcagcctcagtcctcagctgggactacaggcatgtgccacaacacctggctaattttttgtattttagtagagattgagtttcaccatgttggccatgatagtctcaatctcctgaactcgtgatcccctctcctctgcctccccaactgttgggattacaggcatgagccaccatgcctgacctatttttgcttctaattttcatttatttgctatttgttctacttaaatatacaaatatatacacatacacatatttatatgtatacatatacacataggtatacatatatgtatatatatttgtatacatatatataatatataaaactattgatgctttttagtttctaatggaaagcttttatttggttctatgaatagtcattttgttttctatgtatttccaacaattcaccatttgttctgtttattgaaagttcctaaactacctttgtcaagcttcaaaacattgatgaaggacagcagccatttaaatttgattggtttttcttacctctgagtatattgatagctatgataattttaaggttcttggcaaaaatcttataaaagacttatttttatgagttctaaacacaaatagtacattatatattttgtaatttggaaaagtagatgagaatagaagtgtttaaatgatgtttatttccaatgtaattcaattcaatcaataatttcagttggttcagatcctttcctttagtgaagaaaaactgtgatatgggttaaaagttttaatgttcaggaaagactgggctgtttttttaagaaaaattttattgattgggatttctctgaaactactttcattgtgtttaccactattaacattaagtgacactcaattgaattaggtagtaattgctttaaaaattgtgacactttgttgtaatttttgatccaaatccatttatctctgatgggcattcatgtggtacttgaaaacaaaatatgcacaagtgttgcactggtttgaagagtttggtgtgaaagttacttaatcagttgtaagtactgtatctagaagtaaatcttagaaatgtgtgatgatgctcttttaagtagctgaagagagattattatgtggttttcactttgtccttgctttgttgtatagtatttaagtgaaatgagattgcttatccttattctgaatttccaaagctgatatttgcatttgccatttttcaataatggaaaaaaaaacaacattagttgtcttgctttcaaaagtttgtcaaaggacctatcaaaactttgatgcttttggtcacagttctgtcactaaaatgctagcaattagacatatggaatgagtaacctaactactttaacaccgtggtcagaagtgctataagtagtatctgctaagctccaagccactgtgttttaatttgtgacattttagaataataggctttctgtagtataaatatcctattaactaatccttgtgctgttaagttacaggtctttgaatcctcagtctgaagaaagcactgacttctgttaaattttgagcattgataccagtcaaagcctcatcttcagacacaggagaaggtgacaatcaaaatgaactgctttcatgagacacagggccagaaattaaaactattcaatccctctagacccaggaactattgtggaaactgtaggtgtgtgagatggtgagggacaattttgagggacaaactcagttcagagtttctgtaaattaaacgttaatgtcaaaagcacaatgatgcaaggtcagtgtctgggcctatgtgtcagaataacagggttttcttggtgcattgatctgctctttaatagataatcgtaaaaggctataagaactttgtcaaactgattaaaattagatagatttgtttataaggttttattaaaattagatttaacattaataatataccatacaaagatacaattttgttttctcttttgaacaaaaatttcatgtaagaggaaactgcagggaaaaaaaggagaggggagagacagaataagttggcctcatgctatcttaagtattaggtcttattgcttaagaaacagagtctcctctctatcaaaaggtaaatgtttttgttttattattttggctaaataaatgaatattttatagtgacctgtgatcctattttgtgatatcgagtgtcttaaacctttgatactcgacagaatttccaacagcaaaatttcaagttctaaattcagtctttgtgaactcaaaccaacctttttggatattagttgccctgaagttcaagagagacatgtaaggcttattaggcttagttgttatgttagaattatgcaggagatattgtcaaatctgaggtggtgctaagtttcctttgggtgatatttatatggatgggttgttaaaatgtgtttgaggattatatgagattcctgtaattctgatatgtcttaatataagttgtcagtaataattatgattattatgttacattgttgtatgccacagaaataaccaaatttctttatctactgtgcctttaactatgactctcttaagacttttgtcatctacaattattgttttgctttgatccttctcaaaaagtgacttataatcagctacagtctagggattgcttctttggtgttcgtgaaaagaacttttcaatgcaggttactgataactttggagattgtgccattaggttagagaggaaaattccagggcactaattgaaaggctgatgtgttcataaagattgttaacccaacatgaagcagagcaataattgattgcatggactaaactaatgaaggactgaaataatttttgtggcttttatctttggaatattgctgatttttttgttttgtttttcagagtctggataattttttagatctacttataagctttaagttatgctttaagtatattaagtagagtatacttttgtaaacagaacttgaggcatattttttctctgcctattttctccggaattatattcttaattcatgtgtgttagtttgcatacatttaatgacaacttgttttcttgtataatgggacacaattggaggaagtggttattttcttagggctttgaactgaaatgggcttgggaaaggttccagaaaagccagtgtaggtcctatataaacaatgaaccttgttgcactttgggtggttaatcaggctaagtatatgggcctgaagcttcttttgcaagtagatttgtcctgctatgacttgcctttgttggaagttggggggctgaagagaaaatgctgtgtttcagaagaaaatgatactattagattagcctttgatttctgggtggccgtgaaatcacctgtagtatgacgctgcccacgatgcccctcctcagtattaagcagccagaaagactgacaaccagtttccccatgattgaaaattgataaatagaaaggggggactgaaaccgaccaaacagtcccatagatcactttttcgataaacatagaaattgacccttctggtcttaaagcttgaaacttttgtgaattgttttctgttttatgtgagttccttcctcagaaaaccacttgcagcctctcaaaaaagtattaaagaaatgaaacgcaccagatcaccatattcagataatgagatgctagacccctcattcatcatgattgctttcttgcccctccctagttcttgtttttttacacattgttacatttttttccctgctatatattcccataattttagttggtcgggaggatggacttgagactgatctcccatcgcctcagcggcagcacccaattaaagccttcttccttgcctataattgctgtgtcagtgattggctttctgcatggttagcagcaggacctagaccgaaaccttggtgttttcgtaataatcttataattgaaaaagatccttaaaacaatgtaatttaagtctcattttacaaaagaggattttaaaaatggaaaagatttgctgactgaatcaagattataacattaattagcaacagcagataaactaaaatacaaggcttctgaattcaaaatctgctttccatttctccctacgtcctacaagaacaaatatgtaaaataaactggagaatttttacttatctatgtgtgaatataaaacatttttggtttgtaataaaggatgttaccttacaggaagccataaattatttcaagtctgaggttcagactatgaagtcacaattttaaattattaatactgtgaatcaaacttcatctataacacttattgtaagaataacataaaatatgaataaagaagagggttggaaaatagacttaagatactttaagtttgggaatgatataattataaaaagacaactttttcatatgacaatagtaattagtagtaatgagataatgttgctagcttatagaggattgtattatcttattattattttctattatatatgtcaatatgtgctacaaggagtctatttgtaattctgcatttctagcttatttctaagatgaaggttacagatatttatattgctttttctggtagatttcagacagattaattactgtttttgttttcctttgtcttctaccaatattgtgctagaaaagctatgtttacagtttgatgttcacagattgtattctattatttttgaaatacatatagaaatctacaagagcaaaaacttcacattgaaaaccaatataggaggacagagaaaacttttctggagaagttacagggcagagttttaagatagaagatgtatttatatataaataccacagaacattaatagacagaggaaaactcacatgtcaatttacagaagattaaagaaaagaaatgtatgttttgtggaactaaagagaagggtgtaagtaaagcagtagtaagagttaaggtacagaggtgggactcatgggctatatctgttgatataaacttcatcttgacaatgaggctcagctggtaaagtttaagcagattagtgattataaccaaaagtgccaagtcattcacagttctttaacacactactttgttttgtttcttttgatcttcttgtttcctctgctgggatattccattatcattcttgcccaggtaaaactgcacttgtatttatctactgctatctgtctagatttacctgtgcctgcatctgaatcccatgtgggcagagatctcattttacttgttttatatttctagtacctccccaagagactaatatttgtgggaacttagacaatttttataaaaataaatgaataaataaatagcctcatcattttttactaatgataaacttagcatgtacatttgtcactagtaaaatgatcttttaaagagaaaattgtattttaaaaagaatgtataatcacaatgggaaaataattgtatttcaaagtaaattatttcatctcatattaattaaacatagccttgcattttatgaaaagaatgggaatttaaaacgtatgttagcccatgcatcagtcatttttatcgtaattttattagaagctatttggggagagagagtgtctcttattatctaattatcaaacagtagtgctttattcatgttaggatgaagtaaatatttacttaatttaattggataacgtaagtataagttaaccaatatacacgactaaagaatatcccaaaataacttaagtgttttttaaaagcttttggtttttatttcttctgtatgcttatcaaagtctcaaaaaaaagtaaaacaaaacactaaactatgtactattccttctctcactctctgaatctttagctggtttactaaattagaataacacagacatacgtatttcattcatattggacttattttcagtcaatattactacatttatggatgaaagctgtcaattttaaaataataatatagaaaactgtctaaattctgaagcctgctgtcattttttgatgttattatttagttagcttacatgccatggttgctggctgggtcgatctgtaaaaaaaatcactatatatatagtgtgtgtatacatatatatatagtgtatatatatagtgtatatatatataatgtatatatatagtgtatatatatataatgtatatatatagtgtatatatatataatgtatatatatagtgtatatataatgtgtatatatacaaatatataatatatatatttgttcataatctttaaatataatcttccttataaaagaagtctgaaagcaaagcctcataacttttcagttcattcatcaattcaatttgaaggattaactcctctccagaaaatagcaaatatgattatcctacagtgaacatgacattatctcagcaggtagaatggaagtatatggattttattctctgcaggtcccacttgatatttcaccaaacattctaaggtgagtttttagtatccaagacattatttaatgaaaataaatgtgaagctaggtcaactaaatttctgatgtcacagaaaagacgtgtatactcagaatctgaagatggcactttgttttctggcgtggaatacaattttacttaagtaaaaaacatttattgtattgataattatagacaatatattatccaggaaaatcaatgatatgtcttacaaatagaaactgagcaaaaagaggaatataagatctcattcattaaataatcaataaagtgatttaaaacacttcaaatgtaatatattggccacatatagatcagaccagatttatttagcacaacacaatcttcaatgaaaaatatgtatatataataccaacttgtggttggttttattttaatattcaagactaataaattaaaagtcttgaatattaaaagactttaataaaatcaaaataaaaaaacaaaaggtgactttgttcttataaatagcattattatcattgctactaaacaattatagttttcctccacaacagtaactacaaagattatagatatgaaacagtggaggaaaaagctttaaatctaacaactctgagttcaagttatggtcctactacttgtttactaggggagtggaagtgggaaaggggactgctgagccaagtcaattatcctatttcagcctcagatttctggtgtgcaaaactaaattatgcaaaagtcatgatgctattgttaatattagaaattatatatataaaggagctagcaaggtatctggtcctagtgtatgctcaataagtattatcaatcatctttaattcctcttcagaataacctagcacagatgaagctattatttaaaacgcactcaaaccttacttggctcttattgtagattctgtaactactcaatgtataaaagtattctatatatttcttctaagaaggagcccttagctgtttatcaggttcaggcatacagagtcctccctcagcatccatgtgggattggttccagagcccataaggatactaaaatctgcagataatcaaggccctgatagaaaatgagacagtatttgtatataatctatgcatattgtctcatacactttaaatcatctcgagattacttgtaatacatataaaatattaatgctaatagttgttatactgtagtttagagaataatgacaaaaaaagtctgcgcatgttcagtacagatgtaatgttctccccaaatattttcaattgttgcacttagttgaatctactgatgtggaagccgtggatatggagggccaagtgtatatttgctttttggatatattaagtttggccacatccaactaaatgtgtccaaaattaaattgatgtcctcacccaagccatgtgcacccctattgacatcaacatgacgtcaccttaagcaaaaccctgggaaatattttatcttatttttgacaaatctatttctctattcttcctaacatacccagttcaaaacattagcagtatttcctgtagactcttgtgcctctgctcccctaaaatctgcctcccacagagacaatcagatggattttacaaaaacatgttttctcacttgactttctaatttaaaagtctttccaagaattcctcctattgactagataagtctaagtttcttataaaagaaaattaaattttctgtggcatggccttttaattttccagccccaccttgaatcagtttatgccccagtaacactgactaataattatctataaacaagaagctatttcagacctttgaggctgtgcaaatagggtcacatacttctttttcatttggtcaacctcatcctcttattgtgggatgacttcttggtactccttcattatcgtaagttccccatcaataaccccagaaagcccagaatttaccttaatctcaaaattgctatgctaaactcaatttaatttatattctttatatactttactgtattttgggggctttcaaatgatggtactgtagttatctttgttttccagaatgtagtaaatggtagtatgtaataaatggtttgttgggctgaaaggaaacttttcctatcacagacacctgaaggaaatgaggccattgagaaatctgagaaaagatccatccaggctgagagaagatgaaaatcaagctcaaaagcatataggtagctatgatcctcagagatagagaggagactggtgccacaactggaatggactaagaaaagcagagttgagtaggagatgaaatgtataaactgttgacatgagggagtgtcctacctgtagtgatagctgacaaatttcactgagcccttttgaatttattttaatgatttgccttttactcagagtgaggtgtgaaagcactggaaagcttgagtaatggattgagatgttttccatgttaccaggatcacccaggctattgtgttgagaagagattgaagagagcacaggaagacttgtaattggaagaagttttcaacactctagactagagattgcagtggcttggactggaatgctaataaccaaagtggcagcagttgttgctttctgaatacatttttagagtagaacacagaggagttgctccaggttatgtgtggagttggggaggaagaggggcattgaggatgactctaagggtgtttggtcagagtgactgcaagatgggagacgccttaaacctcttattggatataaagtcaccaataagtttgacaggagtactgttgaaatgaatgtcaggcatgtaggaagtaaactcttccaagtgtgacttccagtatgtagatgacaataggatatgaggttagaaagaagaaaatttattgggaagagacctatcatctgtcgatgacagcaaggaggggtaatgggcgttataattattttttgacacgagattcaaaggaaaacaaactattgaggaggaggaaatctagtttaaaaatgtaaatgagaatctaatactccaccaaccgtatctctgtgattaatgatgatcacacaccctgcaaagtttagttacagtccatcaagtttcctacacctggtgtagtattgagttatctgacaagtttgatctcgtaagattcttgagacttccttttttttttgaactaatattagtaaactgtatcttttagaagaatcatccatttctgttttcaaattttgcatacatttaagcaaagttgtctctgaatcctactttttttctatttatatgtagtttcttcattagattttattgtatacagttttacttgttctttttttcttgattaggttagatagtattttatccaattaattatgtctttatttttgttgtttctttccagagaaccaaattcagtctcatttatttgttttatatatgtttataatacattcatgtctgatattatagttattaattattttgggggatttcttgtgtttttatttgtttcttttatgaagtattatgacaactatacataatcttgataggatttctcaaaaagaaaagtacagactaattttattaaataaaataacagcaagcatataatatcagcttatttcaagagaaaaaaattatgtcctaatagaatctacaccatggatgcaaaatagatccatctaagccatggatgcaaaataggagctatagtaagatcagtcattatatcatcaactcaagaagaaaagtcattactgtcctcatatatggtagctatttatttgatctgagaaaagcaccattactattttaaaaagtcaataaaatagaaatagatgagtatttttttaacatattaatagtttttaaaaccatagaccaatctaatggggaaacactgaggcagtctcattcaagtcacaaacgagacaagcatttttattggaagtataataggaaatgaaagtaaagaaagaaaatggaggccaggcgtcgtggctgatgccagtaatcccagcactttgggaggctgaagtgggaggatcagtagaggccaagagcttgagacgagcctgggcaacatagcaaaattctgattctacaaatttgtttttaattagctaggattggtggcctgaacctgtagtccccactactagtgaggctgaggtgggcagattgcatgagcccagagtttgaggcttccattagccgggattgtgccgctacactctagactgggagacagagttagacctgggctagggggaaaaaatgtaaaagaaaaaaagcctatttacaataaaaacaaaagatgtagaaatagatcaagtaagaaatgtacagaacttacataaaaagaaaaacaaaaagcctgctaaaaaacacaaaaaaatgcatggacaaatgcaaatgcaaaatgttcttggatagaaagattcaacatcaaacatatataatatattcctaagtaattaatatataaatctcttgtgttcctaataaaaacacagttaacaacaaaaacactgaactagcttatttaaagtcaaagagaaaacttaacagaaggagagggaacattttggagggaaaacagcattgaggtaagttagtagcaccagaggatagagcatactatgtaagcttaatcattaaaattgtgtggtaataggttataaaatataaataatagaattgaatagaacatttagatcaaaatcaaaacacataagaaaatatatgatataataaatgcaacatctcaaatttgttcatcattggatgaatatcacaatgtattgtgtggggaccacagagtatttgactggaaagaactatggctgcattaatacctcctactgtgtactaagatacatctcaaatacaataaagatttaaatatacaatatgaatccacataaacactagtagaaaacgtagaataactgtaatctgggcttaacataccaatataaaaaactgatatacttgcacatattcaaactgatgcatgttgagtgttaaatatttctccattgtcaataaaagaggataaatcgaaaagtttatcaataatagacttcttctacagttttatacttattaaggaatatgtttatcaataatagacttcttccatagttttatacttattaaggaatattacataactgtgaaaaaaataatctgaaggatttatctagtatctacatggagaggactccaggatacattcattgtgaatggaaaaaaaccccagcaaagtgaaggaatatattaatatttattcatattttcttggaatgatactgaaaatctggaaataaacaataaattaacaaaagggatttctcaggtgggagactagaaagatgcaattgtaatagcaggaaatcttttagcttgctgtgtgtgtgtgtgtgtgtgtctgtgtgcgagtctgtgtgtgtatacacatatttaaatacatgtattattttacataactattttaattacctatacactcagaagtgactttgaaaccctgagacattacatgccactgacacatctgttaatttctttgaagaaaagagcctttctctgtctgcagccttacttttccataataaatttgaaatatgcctctgatattgtcctcttcccaaaatttaaccaaatcagaatatgcatgcagttcctgagaatctggtctctctgattttctgatctaatttagatgtttataggataaaagaatacttgccgcgcttcttaaatttaattacagggttaaacgggcccgatgaaaagactgcattggttctaatataaattaccttcgctctgcaggaggagcattatccgctgcttggaccgtgagtgcgtaagtccgcccgactatcatttccacccctggagcgatggtgataagccctgttgttttattgatgatgaagtctccctgagccccaacaaggatttcatatgtgatctccccatttgacccttcgtctgcgtcgactgcagtgagctggaattgaaaatcacaacataaatcctcttgggtctcaacttttcaccaccatgtcgttttttcccccaacaaaagaagcttgctttcaaagaaaaaaacacaggaaagtttccttgacatatatactgttttttgttttttgtttttttaactgaggctactgtgtcctgttacaatactaaagcaatcacaaaaataagagtgattttgttttttgtgagagtgattaagaaataaactttggatcttgaaggcttatctttattttaatttaataaagggaaaaagaggaaagccctaacagaaaatctaatatccctataggaaatttatttttcctgtcttgccttgcattcttgacacataaactcatattaaaacagactgaacctggaaaaaatgaaataggcatagtcggcctttgttactcccaaccttccttttactctcatttttccttccataatgttctcctccctgtctcccagacactctcatctttgtgtcctttttgtttacaattgctctaggaaaggttattaacttgcacaccctgatttataaaggactgataagtcgtagagtattaatgtgtcaacaatcaaacaaatgcatctcccattgtagaatatcaagggtaacatagcccaagaaatgtttctttggggaaagaaaatctattcggagcccttgaaattaagcatgtaaacatctgtatagccaatttacatatatctataatcattttgaaggaactggtatctaaaagactttatttgggatattatatgaaaagataacaatgattaacttcatcaagcaacattaaagcaacagtgatttattatattaaaagtggctccttgacttgctgataaatataaattaaaggggaaaaagaatataaagggattctagcagaaatcttatagtaagcattttacatacatcaatagtattttctgtattcatcatacaaaaagtgaagaatgaaagaaagtggtctcaatttacacatgagggaatataattaaaagttttctgtggaataaagaaaacacatgtaattgtagtaaattaacctacctgtagaaatgttttatttacttatatttatattttcaatacattacttctaaaaatagtagtttttatagtttgcagactcctttgaaaatacagtaaagatgctggtataccttccttgatcaaatgtaaacatacacatttaccttgaaacttgaattcaatttcagaaacatcatattaactaatttcccattcaaaagttcatgtttaatatcctcaataaatgtaaacaaagtactttatacactgtactgtgctgaaggggttatattatgcatattctattttttattatatgtcatgcttagagtgataatgtccatagacatagcagcaaaaaataattgagaatgaaaaaggaaatgacattaatgcaactaagtcctgagactggctatttgggggtggacagatgtggttgctggaaggaaaggcattttatgacatgattctgcgacttgtataagcctgacagacatattcctaaaggcaaaggagaaacatttgcagaaacagtcaaaatgaatggcatatatttatagagagctattcaagccagacaaactaattctgttttgtgtatggataaaattagaaaattagaggatggggataacagaggagatatcaattttgattatacttaaatcacttaaaatgtctcaggaaatcttaattaaaatttagcacaaattggattcaatattaacattcttcctgggacttaaattggctaaaggaatgtaatgataaatggcaatgcatcaagttaagaaaaggtgttaaggagtgtgcttcagggatgtcagcattatagctggtcttatttaacattttcataaatgatgttggaagggaggataagctggatgataattacattgaagaaggtacccacctgggagatgctagaaataccaaatagtactgcaaaacacaggagacagaaacacccactaaattgcagagatagtcaaccacagttgagctaaggtattcagggaacacaattagctctgcagaaattattaggaggtagaaagcttaacaagtacacaaaataaggattctatgtttaagttacctagataacactatttttcagtcttttactactaaataataaaataatgggttatgagtcaatataatttgtttgcatgtatgctaacaaagatattttaaggaaattaatcgtagtccaccgtcagaaaaataagctgagacactgattctgaatacccaaatcataatagtgtcttccatgtaagatcccgaaaactcaagacctttttttttttaaacctcaacattagcaggagaattgcttgaacctgagaggcagaggttgcagtgacctgagatcatgccactgcactccagcctggcaacagagtgagactcttaaaaaaaaaaaaaaaaaaaatccaaaacctcaacgacattacacagtagatgtccccttctgaagtctattagatgatgttgaatggagttgtagttgctaattttggagctaacctatggcaagaatttaattcaattatagttcaatgactctgtgaccagtagatagtgtctatgagatggaaatatatgaagctcatttctaatttagcagggaaatctgcttcctaaatgaaaagggcatttatttacatggggaggccaatattttgcttacaagtttcagatgaaagtaaaaacaatactataactttaaagtgtttattgaaacattgtgatatctaaaaggtaagaaattgtgagctatttgttttttttatttcttttcgatgatgttttatagttctattcaggaactttagccctaccctttcataattccttcctctcagtgtttcaacatgtgcatattccaaatgtccccatctgtattagtctgttttcatgctgcttataaagacatacctgagactgggtaatttacaaagggaaggtttattggaatgccacgtggaattccacgtgggtagggaagcctcataatcatggcagaaggtgaaaggtgcatcttatgtggcggcagacaagagaagagagcttgtgcagggaagctcccctttttaaaaccatcagatctcatgagacttgctcactatcacaagaacagcacaggaaagacttgccccaatgattcaattacctcccactgggtcctcccacaacacgtgggaattcaagatgagatctgagtgggaatacatccaaaccatatcattccaaccctggcccctcccaaatctaatgttctcacatttcaaaaccaatcatgctttctcaacagtcttccaaagtcttaactcatttcagcattaactcaaaagtccacagtcaaaagtcccttccacctacgagcctgtcaaatcaaaagcaagttagttacttcctacatacaatggagatacaggcattgggtaaatacagcctttccaaatgggaggaactggccaaaacaaaggggctacaggccccaagcaagtccgaaatccagtggggcagtcaaatattaaagctccaaaatgatctcttttgacttcatgtctcacatccaggtcatgctgatgtaagaggtgggtttccatgctcataggcagctctgtccctttggctttgcaggggacagcctcccccccaactttgtttatgggctggcattgagtgtctgtagcttttgcaggtgcatagtacaagctgtaggtggatctaccattctgggctctggaggacagtggcactcttctcacagctccactggtcagtgccccagtagggactctgtgtgagggctctgactctgcatttcccttctgcactgccctagcagaggttctccaggagggccctgcccctcagcaaacttttgtctgggcaaccaggtgtttccatacatcctctgaaatctaggcagaggttcccaaacctcaattcttgacttctgtgcacctgcaggctcaacaccatgtggaaactgctgaggcttggagcttgaaacctctgaagccacagcctgagctctatgttggaccctttcagccatggctggagtggctgggacacaggacaccaagtccctaggctgcacacagaacagggaccctgggcctgcccatgaaacaattttttcctcataggcctctgggcctgtgatgagagaggctgctgtgaagacctctgacatgccctggagatattttccccattgtcttggggattaacattcagcttcttgttacttatgcaaatttttgcaggtggctttaacttctccttagaaaatgggattttcttttatattgtgttgtcaggctgcaaattttccaaacttttatgttctgtttccattataaaactgaatgcacttaacagcacccaagacacctcatgaatgttttgctgctaagaaatttattccgccaggtatcccaaatcatctctctcaagttcaaagttccacaaatctctagagcaggggcaaaatgccaccagtgtctttgctaaaacataacaagattcacctttgctccagttcccaagaagttcctcatctccctctgagaccacctcaggctggactttattgtccacatcactatcagcattttggacaaagccatttgacaagtctctaggaagttccaaattttcccacatcttcctgtctttttctaacactccagactgctccaacctctgcctgttactcagttctaaaattgcttccacattttcaggtatgttttcagcatcaccccactctactggtatcaatttactgtattagttaattttcacattgctgatatagacatacccgagactgggcaatttacaaaagaaaacaggtattgaaattacagttctatatggcggggaggtctcacaatcatggcagaaggtggtagcagataagagaggagagcttgcgcagggaaacttccatttttaaagctatcagattgtgggagacttattcactatcatgagaacagcaagggaaaatcttgcccccatgattcaattacctcccaccagatccctcccacaatacttgggaattcaaaatgagatttgggtggggacatagccaaaccatatcaccatcaatcacccatgtgaccacaaaataatctaagttgctcctaatgtttccttttaaattttggctgcagtttactactctctttaattgctctttcctggttctgataaaaaaaatacagcttgatataaaaggacaaatataaagatgattgaattgtgcataagctgaacaaaaacattcaaattggagtctcaaaaatgacacagaaagccacagttgatataaaccatatgcaagaatataaattgtaatgcaagagtgtaaacacggtattttatatgaataaatatattttttattagaagtgaattatgggccggaagctgtggctcacgcttgtaattccagcactttgggaggctgaggtgggcagatcacgaggtcaggagtttgaaatcatcctggctaacacggtgaaaccccatctctactaaaaatacaaaaatattagccaggcgtggtggcgagcacatgtagtcccagtgtttttgggaggctgaggcaggagaatggcatgaacccaggatgtgaagcttgcagtgagccgagattgtgccactgcactccagcctgggtgacagagtgagagtctgtctcaaaaaaaaaaaaaaagtgaattatggcttaattgataatgcatgaatgtgttgatcatttgatgtttttgcctcttgggcatccttggctcttgcttccagtaaaagtcccttattttcctttggggagcaattggcaaaaaaacatgtcaagttattcaagttggtatagtcaaggtgactcctagaactactgtaaaagagtgtttttttcttcctctagggctaaactggtaaatttatatctggtgtttctgctggctttccagtcttcattggatgtacctaagactgagacccatacagaagaagacatgtcaagaaataagcagaaaatatcgctcatgacatggtttctgcttatgcctgaaaccaaattcaccactttctgatagattaaaaattacatattttaaatgctaatttattttgaaattatgtctttcaaccgtaagaaccctaaatatataaaatagttttgatgcttaactactcttcttggtttgctttttgattatttttctaggattattgtgcttcgagattttggtttgagataccatgtaatcattaatacaataatgtaatatataattattcattacaataggcaaagatattgcttgaaagtggtagaattgtccctgtatagaaataatattgaattactcaataagtaaaaaaatacagataaattagctggtaaatatttccatcaagagaggacagactcgatttcagggaaatatttaaatgagtattgctttgttttttcttcttcataatttcatggatagaggattcattcttacatagatatgagcaacctcagcatacaatttttttcattattaagatgagaactttcacattttaacttaaaggaagcactttcatagcttctctttgatatatatgaattgccagaatcactactcctgtgctttgggaccattgttatgtaaaataagggtaccaccacaggtaatctaataacagagatagcttctaagtgactcatgggcagggagcatagatgtcctggagatgctggacaaaaggatgattcatgccccccccaacaagctggggacagagtaggacacctcaagatttcatcacactactgaaaatggcacaaaatttaaaactttggaattgttgatttctagaattttccatttaatgttctcagaatatagttgaccaaaagtaatagaaaccatggaaagcaaaactgaggacaagggaagaatactgtaaaaataaacatgaactgagagatttacctcacagcatatgtaaaattaactcaaaatgcatcacagacctaaaggtgaaagctacactatgaatactaggagaagataatataggagaaaatctttgtgaatttggttggcaaattttcttaaatatgacagtaaaagtatgatacaataaaaaataaacttcctaaaaattaaaagctttttctctaccaaaaacataagaacatgatacataaaatacagattatgtatttgcaaaatatttgcagatcatatatctgataaaggacttgtatttataatttatagagaatacttaccagtcagtactaagaaaacaaacacaaattttttaaatgagtgaaagatttgaatagatatttcaccaaagaagatcaataaatggctaataagcacatggaagtatctcaaattaatttgtcattaagggaacacaaaatcacaatgagatactaataagcatctgtataatggctttaacaaatgaactgacaatactatcagagaggatgtagtgggtggtaaaatggtacaagccactgttattaaaaagcagtttgacagtttatttaaaaagtatatatttaccatgtaatctagcacttttcgtaagatatctatatataacaaacagaaaaataaacatatatgtgtatatatatgtgtgtgtatatatatttacatttccaaaaagtgacttatatagaatattcacagtcacattaaactggaaacaactgaaatgcccatcaactggtaaacagataagcagaatgtgttttcacaagatggattctattaagtaactcaaagaaacagatatatagcattgattcatgccacagcatagatgagctacataaacattatgctatttaaaaagccaggtaaaataaaagtaaaagatacatactatgggactccatattttttaattcctagacaaggaaaacttttagaggcagaaaccaaaacagggggtgtctacagctgaaaatgggagtgagcattgactacaagtggtcatgagtaaagttttggggtgatggaaattttgggggtgaaagaaatgtatagaactagattgtggtcattgttgcacaactgtctaaatttactaaaaccagcccaactctttcatggaactgatgtttactggtctttgaataaacacagaaattgaccccccacccccaccccaccataccctgtcttgaagcttgaaacttacatttgtctcatgggagtttcttcctcaggacactaaccctcaaccctcctagaaaccaaggaactgaaactcaccagataactgtatccagaaaatgagatgccagacctctcatccatggattatgattccagtttaccaattcctcttccttaccctaccctaatatttgtttttgcacaagtattttttccctgctatataaacccctaattttaatcatttggggagatggatttgagactttatctcccattctcctcagctgcagcacctgattaaagttttcttctctggcaatatttgttgtctcactgattggcattttgtgaagcaagcagcaggacctagatgaaacccttgatgttttggtaatatacatacatgaggacatgtaaattataccttaataaagttatcgaaaataacaaagataattccacccacacatctgacctttttaatgatatttatccatttttttctgctacattatagaatgcccttcaggctacttgttcatgtattgtttcatcatttgagtaactttcttccttcttcctgccttcttatgcacctcacaaagtttagatcttgattatttgtttctttctttctcttttaaaccactgtatgttcctctgccttcagagactttactatcaactccatgaactccatgctacctttgtaaaactacttcttcctcctatgaatggacaggtatgaaagctctggcaagcaaagaaaagccagacccatggaagaaaagcagaatgtaatcagctaatccaactatgaaaggctgtctgtgttgagaaaagtaatcagtagaagagaaggtgaaattgtggaatatagaatggagagcacacaaacaaagatttcaagataagataccttcatattttcctctgagagaacattttatagcaagagtataatcttcttagcagctcccttcagatgtggtaatgattaatggccaatgctggagaattgcacagatttggcagaaatcaaggtacaagatatacttgagaactctactgggatcatttggggttaatgtctccttatgacatgccagaatatgagataggattgtatcacttgggcctttttcgttggttatatttatcctaattttacatttgaagccttgagttaaattctaactttgaccttatctgatatgcagtggctggcagccatagcttatacatgtatagatatgtataaaaatgacatcacttaaggcattcttcggtggtttcctagtatgacagagtcgatttttcttttttgcctcaccagatgtgtttaagtgtgggatgaaatataaacaaacgtttatggaatcagtattgtaaacaagaaggtgaacagtaaagttatatggtgaccccatatcctgatgatttgttcctagaaattctcaagggcaattataaggatccttttgcacactcaggttgaacttcacctagaagtagaatatgcctaatctacaagcttctgggagaaacaatacttctgtatgcacacaatatacttgaatcgtattcatatcatatatacttagaggaaatgtatcagtctattttcacactgctataaggaactaactcagactgggtaatttatgaagaaacgagttttaattgactcacagttccacaggcttaacaggaagcatgactgggaggcctcaggaaacttacaatcattacagaaggcaaaggagaaggaagcaccttgttcacatggcagcaggagagagagagagagcgagaggagaagtgccatatacttttaaaccatcagctctcatgagaagtcactcactatcatgagaatagcatgggagaaatttgcctccataatccaattaccttccactaggcccctactccaatactaaggttcacaactcaaggtgagatttgggtggggacacagagccaaaccaaaccgaggaacaatccttgagtcaccttaatcaacactggacataaagaactaagagggatttgaagttcaataaattagtttactgaatcaagtagagatggcttttaggcaaacatattaacctaaataagcagagtagggaacattctttttcaataacttggcattactcaggaatgattacagagtaatcaatgattactgaaataacaattataataaattctgatgtatttaaatggttctagttggctatactagaagatcaagtcaggagggacatatctctgggaactacggacaatctaaactataccaagatgtcatttgtaagtatgggcattatcaatcttctattacagtcatatttctatgaactaggaaacaaacatcttcttcatggtacctttggcgaagtttggacagactaagaatcaatgcattgctttattaaagaaaagtgactggtgtgctgcattcatatgcagaagctttcgctagtgaaagtttattcctaggggatggtttatagttatgctatcagaccagatgcagaattgtcggagaaagagtatctaatgactactctggtaatgtaaaatgtatgatatgtaggaaaagtctattttttgctaggaaagttgagaaaataatttggaaatattaaagtgtattgtgttaaatatttcatctctctgcctcagctctatcgtgtgataagggatttttaaattcatttatgtagttagataaaaataaaatctgagtgcatactgatctctaggacagaaagattatttggatgggcaacataaaacttacaactaggtaatccttatgtagaaggatttgccagagaaagaattgaatttacgtgtgtaaactaatatacccagttgaatgtatcaacacttataaaaaggcagaagtaatagaggataagggggaaaaattgtctttcaaatgttaaagaaatatcagaacagttaagtgaatctatctatggttgttaatttgctttgtagagggaattccaacttcttagtgtatgaaatatgctctggtgatagccagtgttttaacatctatttttaatgcactagatattatagaagttagtgtaacaaaaattttaagaagattcctcagaaatgtgtagcaagtgggtaacacataatgagtgcagatgacttagaagtcataagatattatatctaaagttacaagacttctactatgctattgccatagaagctatattgttgcctgcctggtatccttaattaaagctaaatcaacttggagctgtgtaaggtctactgggtctctccaggttggcattcagtctgaacctaaggctgctgctcattaaactatcactggaaattcactattcagtgtgatttctgatggaaaaatgatataatgggtttgcttttatgtttgttgatttcttcatgtgtcaataacattcaggaagttcttcaataactcctgctggccaagcaaattggggattgcaaatgtatttattttcagatttattctctgtggccttaatgtgaacaagtgatgctttaaagccaaaaagcataacaggctcccagttttcccccttctcttacgcatatcctagaataatccaagatgatgggcacctcagtagggtaggtggctggcaaatttatcactttggttgtataatttggaaaaagatattgataacattaataataacatgatcattaaatacttatatgaataattgtcaccgaagatgaatctcccatctatgcatttttcttcccaaaaaaaggcaagaaataaaacaacaagaagatgactttaaagcatttcttttcacagcctgactatttaaagggcttgtttcttttctgcagcaacttcatgatccttttgtaaaggttcattggttctaattactcaaactctgagactggaaactggaaccttaagtgctctaatgctatcaaattctctcatgcccaacttacactctcaaaaaaagatttcctcaaagttggcttccattaatttccatctcattagctttaacccatcgatttaaggacccagtctttcatacttcttcaagaaatctcacgttgtatacaatgccaaatctaaactactctacatgcaaggtagccatcttaaattaatttataaataattggatccatttattcagaccttaatttgtaccaaatgtctgactccgaaaaatgaagagtggaaaagaaacagaaacaataacttctgtcaaacagaaggtgctctaggaaaggagatgagagagaaacctatctttaaatgaaatgctgttacagaaacataaaaatactttacaaaagtacagaaaagcctgtcatgacaaaggggctgggagaataaaccaacatatatttgacttagtaaaagaaaagcaaatctttgagcattcagttcctcttctctccaatgccagttaaatttgtatctttaatgcctcatgaaattactatgcctttggccgtatcatttcatcttcaacatcatattatcttcacttgcctatctgagtactctaacagatcatcatccccactcacttttgatgaattctcgttagtgctcttagtctttctcatcaaatttaacaactcaataattgtgatgttttctgattatttcactgtgaagaaggattatttcttgcaaaatatagtcaactccttgaggattagggctgtgccttactcgttctacgtatttttcagagcacttagtttagtacgaatcacctaaaaatctgtgtagattaaattataatctagccaagaaagtaatacaacatgtagcatacatatattaggacttgcacaatagtgcttttgtttgtttgtttgtttcctttgccaaactggatgagcaagtttactagggttttaagaaatccctactgctctatttaaatgtttgttttttcccctaagatctcctgtatttgaaatatctcaatacccaactatttttattttactcagatgactatgcttggacattataactgtcaggcctctgagcccaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctcgctcatcctggctcaaaaagcacctccactgagcaccttgcgaaccccactcctgcccgccagagaacaaaccccctttgactgtaattttcctttacctatccaaatcctataaaacggcctcacccttatctcccttcgctgactctcttttcggactcagcccgcctgcacctgggtgaaataaacagccatgttgctcacacaaagcctgtttgatggtctcttcacatggacgcgcatgaaatttggtgccgtgactcggatcgggggacctcccttgggagatcaatcccctgtcctcctgttctttgctccctgagaaagatccacctatgacctcaggtcctcagaccgaccagcccaaggaacatctcaccaatttcaaatcaggtaagcggcctcttcttactctcttctccaacctctctcactgtccctcaaccactttctcctttccactcttcaatctctcccttctcttaatttcaattcctttcattttctgggagagacaaaggagacacattttatccgtggacccaaaactccggcgccggtcacggacagggaaggcagccttcccttggtgtttaatcattgcagggacgcctgattatacacccacgtttcaagggtgtcagaccacacagggacgcctgccttggtccttcacccttagcggcaagtcctgcttttctggggaaggggcaagtacctcaaccccttctctccttgtctctaacccttctctgcttttctgggagaggggcaagtacccctcaacccctcctctttcacccttagcagcaagtcccgcttttctacagggcaagaacccccaatctcttatttccgcaccccaacctcttatctctgcgccccaatcccttatttccgcaccccaacctcgtatctctgtgccccaatcccttatttccatgccccaaccccttatttccgtgccccgaccccttatttctgtgccccatcccttatttctgtgccccgacctcttatctctgtgccccaaccccttttcccacttttctggaaggtaagaacccccgaaccccttccctctgtttccctactctctcttttctctaggcttgcttccttgactataggcaaccttccaccctccattcctccttctactcccttggcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaagatctaaataattcttgtcgtaaaataggcaaacggtctgaggtgcctgacgtccaggcattcttttacacatcagtcccttcctagtctctgtgcccaatgcaactcgtcccaaatcttccttctttccctcccgcctgtcccctcagtaccaaccccaagcatcgctgagtctttctaatcttccttttctacagacccatctgacctctcccttcctccccaggctgctcctcgccaggccgagctaggtcccaattcttcctcagcctctgctcctccaccctataatctttttatcgcctcccctcctcacacctggtcgggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaaaatccagcccagttcatgacgtgtttggcagcaaccctgagacactttacagccctagaccctaaaaggtcaaaaggccgtcttattctcaaaatacattttattacccaatctgctcctgacattaaataaaactccaaaaattaaattccggccctcaaaccccacaacaggatttaattaacctcgccttcaaggtgtacaataatagaaaaatgttgcaattccttgcctccactgtgagacaaaccccagccacatctccagcacaaaagaacttccaaatgcctgaaccgcagcggccaggcgttcctccagaacctcctcccacaggagcttgctacacatgcaggaaatctggccactgggccaaggaatgcctgcagcccgggattcctcctaagccgcgtcccatctgtgtgggaccccactgaaaatcggactgttcaactcacctggcagccactcccagagcccctggaactctggcccaaggctgactgactccttcccagatcttctcggcttagcggctgaagactgacactgcttgatcgcctcggaagccccctagacaatcacggacgccgagcttcgggtaactctcacagtggaaggtaagcccgtccccttcttaatcaatacggaggctacccactccacattaccttcttttcaagggcctgtttcccttgcctccataactgttgtgggtattgacggccaggcttctaaacctctgaaaactccccaactctgttgccaacttagaccatactcttttaagcactcctttttagttatccccacctgcccagttcccttattaggctgtgacactttaactaaattatctgcttccctgactattcctggactacagctatatctcattgccgcccttcttcccaatccaaagcctcctttgcatactcctcttgtatccccccaccttaacctacaagtataagatacctctactccctccttggcgaccaatcatgcaccccttaccatctcattaaaacctaatcacccttaccccactcaacgccgacatcccatcccgcagcacgctttaaaaagattaaagcctgttatcacttgcctgctacagcatggccttttaaagcctataaactctccttacaattcccccatttcacctgtcctaaaaccagataagccttacaagttagttcagaatctgcgccttatcaaccaaattgttttgcctatccaccccgtgctgccaaacccatatactctcctatcctcagtacctgcctctataacccattattctgttctagatctcaaacatgctttctttactattcctttgcacccttaatcccagcctctcttcgctttcacttggactgaccctgacacccatcaagctcagcaaattacctaggctgtactgccacaaagcttcacaggcagcccccattacttcaatcaagcccaaatttcttcctcatctgttacctatctcagcataattctcataaaaacacacgtgctctccctgccaatcgtgtccgactgatctctcaaaccacagcaacttctacaaaacaacaactcctttctttcctaggcatggttagtgtggtcagaattcttacacaagagccaggaccacaccctgtagcctttctgcccaaacaacttgaccttactgttttagtctagccctcatgtctgcgtgcagtggctgccactgcattaatacttttagaggccctcaaaatcacaaactatgctcaactcactctctacagttctcataacttccaaaacctattttcttcctcatacctgatgcatatactttctgcttcccagctccttcagctatactcactctttgttgagtctcccacaattaccgtcgttcttgacccagacttcaatccggcctcccacattattcctgataccacacctgacccccatgactgtatccctctgatccacctgacattcaccccatttccccaaatttccttctttcctgttcctcaccctgatcacgcttgatttattgatggcggttccaccaggcctaatccccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagttcgaggatttgccccacccaggactggcaaattagctttactcaacatgccctgagtcagataactaaaatacctcttagtctaggtagatactttcactggataggtagaggcctttcctacagggtctgagaaggccaccgcaggcatttcttcccttctgtcagacataattcctcagtttagccttcccacctcaatacagtctgataacggacgagcctttattagtcaaatcagccaagcagtttttcaggctcttaatattcagtgaaacctttatatcccttacggtcctccgtcttcaagaaaagtagaatggactaaaggtcttttaaaaatacacctcaccaagctcagccaccaacttaaaaaggactggacaatacttttaccactttcccttctcagaattcaggcctgtcctcagaatgctacaggggtacagcccatttgagcggtatagatgctcctttttattaagccccagtctcattccagacaccagagcaacttaagactgtgccccccaaaaaacttgtcatccctactatcttctgtctagtcatactcctattcaccgttctcaactactcgtacatgccctgctcttgtttacactgccggtttacactgtttttccaagccatcacagctgatatctcctggtgctatccccaaactgccactcttaactcttgaagtaaataaataatctttgctggcaggactatgctgaatctccttaggcactctctaatcagatatcctgagttgtcccaattcttagaccttttatacctgtttttctccttctgttattccatttagtttctcaattcatccaaaaccgtatccaggccatcaccaatcattctatatgacaaatgtttcttctaacatccccacaatatcaccccttaccacaaggcctcccttcagcttaatctctcccagtctaggttcccacgccgcccctaatcctgcttgaagcagccctgagaaacatcgcccattctctctccataccaccccccaaaaattttcgccgccccaacacttcaacactattttgttttatttttcttattaatataagaagccaggaatgtcaggcctctgagctcaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgactttaccttgtgaaagtccttttcctggctcatcctggctcagaaacacccccactgagcaccttgcgacccccgactcctgcccgccagagaacaaaccccctttgaatgtaattttcctttacctacccaaatcctataaaacggccccacccttatctcccttagctgactctcttttcggactcagcccgcctgcacccgggtgaaataaacagccatgttgctcacacaaagcctgtttggtggtctcttcacgcgcatgaaaataacaaaatttactaccagtgaaagctgaaaagaaaatgagctcttttttggaaacaataggtgaataaaagctaaaattgatcaaagaaatgtttcatttattggacatatactaaagaaaatagtataaaatatattgtacattttgtttcttctagagcaatatcatatttcaagtcaaatatctagtaaaccagcaatatatagaaccataagtatgagcgtgaatatagtcaaaattaaaaatacacaatttacatgattgtaaaaacaatcacatacaaataagcagaagcttcataaaaaatgcaagcacctaagcattaattattgaaaccggaccatgaaattggacaactttcactatgacaaccaaaaaacatgatacagaaatataaaagtaaataattgtgtttacaaatgagttttctttaaaaagctacactgttaagtatatcaaggaaaggggataacgtctgaaaaataatataaaatctaaatattctgttttcagttacacaaattcaaaatgcaaggaattgtgattactataatgctagcattagtatttcttcaaatttatcaaatgggaaacctcagcctaaactacataagccctaaggttttaagagatactgaaatatgtgctaaacacttaataatgtttaatttgatgatctaagtcatatttgtcatgtattataaaaccaaaatataatttgcctttcttcattagtagtctagtaattacttaaggtcataaactatatgttgatagtttctttatttcttatgatttggcatcgtgcgcaatactttaaatgctctacacaataaatcattttcaaataaatgtgttaattattcaactttgcctctttaacagcatatatgattgacttatgttttcagtcagtttagcatctcaagagtctttttgaagtgattcttctgaataatcaagtttggaagtactacgttatagggatactaatataactgtagtttaaaatattttactttgtaaaaaatttaaaaatgaattaacctgaaatataagttatttcccatgactcataaataaattcctaatacatattttacctacatctattagttctttttatccatttattcatttaacaaataatatttattaaaggtcaatgtgctgggactgtgtaaggtgttaggcatacagtagtgatagaaaaagaagaaaagtatgcaaaaaaattgacaataattttattccatttgagcctataattaagtgagagaaacagatagtttaaccatataattataaatttttaaatgtgctgtgaaggagaaatcaggatgctccaagataataaaggggtaacattgagaagaggaaatcatggaagtcttctttgaggaagcggcatttaaattaagacctaaaagacggaaagcatatgaatgaaagttatctcatcactgtgggagcatcataacaaataagagaaagataaaatgctaagtgaagaaattgaacgctaatccagtaatacaggatatcgattatgggcttcatttttatagcagtagaaaaccattgaaggggtcaagcatgctaattatttgagtgatttcaaatgtaatatagcccactggctaatgaatgaagaagagggaaagaggagacataaataatactcatagaaggacatttcacaggtttaggtgaaagttgatggtggcagtgaaagaaaaattaaggccgggcgtggtggctcacacctgtaatcccagcactttgggaggccgaggcaggcagatcacgaggtcaggagaaccagaccatcctggctaacacggtgaaaccccgtctctaataaaaatacaaaaaaaaaattgccgggcatggtggtgggctcctgtagtcccagctactcaggaggctgagacaggagaatggcgtgaactcgggaggcggagcttgcagtgagctgagatcgcaccactgcactccaacctgggcgacagagcaaaaaaaagaaaaaaagaaaaacaggtagatgcattaaataagtatatgagaaaaaattggtaggaggtggtaatagattggagatgggagtaaatgagtatgtttcaagaataactttttccaatcaaatggaaggtgttgctattttcttttccttctttcttttttctttttcttttctttttttttttttttttttttgagacagagtctcgttccgtcacccagccgggagtgcaatggcgcgatcttggctcactgcaacctccaagagattctcccgcttcagcctcctgaggtgttgctagtttcttagattggggaatatcatccatttgaaaaaatgctgatagtgtaatcaaacttggaattcaattaaagtcctaagcatgagtgaataacctgtataagttcagaattacatgttggtgtatatatttcaattctaatacaaataggtttagccaagaaatggagtggtctttagaaaaaaataaaatgcttcaaatatcaaaaataaattaaaattgtgtactaatgtaaaaataggtccacatttttgtaagctttgctcatgaagactttatccggtatttgctgaaatactgaaccccctcaagaccttaagtaaatataaccctcaaactttaatcatgacattatacacacaaaccaaagaaaacaaaatcattatttgaaagaaattgtcgtctatggccataccactctgaaccctcccaatcttgtgtgaaataaattgtcaagagacattaaaatacgatgtagttttatcttaaacttgaatatttgaaattacaaaaacagaatttaatatgtaattttatatgttatgtacgtgtcctccacagagcactaaataacacaggacactcagaagtatatacagataaggtagcaacaaatattaataatcataagtgctttacataatttatgagaatggtacagtaataatagcaagttaccacatgcagcatttgctaagcatgcatgtgatagtagtttatatagttagtttaataatcacaacactcttttgaggttggtactattattatcaccattttaaagattggaaaactgaggtacaaaaggttatgtcatgtaatggtacaaagtggcagaaagaaatgcaactagctagcctgcctcccaattctattgtctttaaattggattctacttcatctctgtcacttaaaaccctcgttaatttggaacaatcatctgtcattatattaactcacatttttctataaaattaggctataaaaataattatgttcaaagttttttcctatgatatattacctatgatatagaataactacctatgatataggtatgataattacctatgatataggtatacctatgatatagaataactacctatgaataattacctatgatatagaataactaagaaattaaaatatttccaatttaagagcaggaaggggtagcttggctaaagctgtgaagttagagatcatctcgggaaaggactatgtgaggtgatacttagtgtgtgatagaattcttacgccaaatagaacatatatctaaaattaggtgttttctaaactcattgagggtacattagtcgagggaattaaattctatggacattaactgaattcctactgtgtgtaagtcattatactgaccactcgtggttagatcattaaaagtttttgtcttaaaggaacttacagatcagtaggggagacagacacgtaaaagttagccttaacgcaagccacaataaaacatgtgggagatacagttgatagctggtacgtggaagcaattaattttgacttgctaggaaaatatagcctttattaaagaggtaacaattgtactgtgtgttaaagattttcttttttaaagatacaacttggatcaaaccttcaacctgagagagctctcaatagttacagaataagaagaatattccatgctaaaaacaagtaaaacaaaaccctatatattattctcggattcataacatgaagggatgtagcaggagatgaaacaaatatatttaagagtattacatagatgtccttgactgtatgtgtggagctttcttccttccattggtaggttttccaggagggtgaggatctgttctgactcagtttcagaataatcatctgaaacagtgtggtaggaaatccattgaaatagccagattgcccaacatagtttactgtagtagcctaaattatggcagcacataggcatggaaaaggaattggtggtggaaatgggaatgcaaattggtacagtcaccttagaagacagcttctcagtttctaacaaagatatccatattcattctatatgatccagcaatcccactccttggtatttaccaaaaggatttgaaaatttatgtccatgtaaaaaaaaaaacttagcatggatgattatagcagctttattaataatggccaaaacttgaaagcaaccaaaatattatttcatggaagaatgaataaataaactgtgttacatctagataatggaatattatacagccctgaaaagatatgggctattatgtcatgaaaagacatggaggaattttaaatacgtattactaagtgaaataagccagtctgacaaggctacatactatatgattctaaacacatgctattctggaaaaggcaaaatcatggagactgtagaaagatcaatgattgtcaggggaaggaagcaagcaagggggagggaagcataggcagagcacaggatttttagagcagtgaaactcttctgtgtggttctataatggtggatatatgtcattagtacaaaaccataaaatgaagcaccgagagtgaatcctaatgcaaactacagactttggatgataacaatgtgcgaatgtaagttcattaattgtggcaaatgtatcactttggtatggggtgttaatattggggcaggtatgcatctgtggggacagtgagtatatgggaaatcactgtatcttcctctcaattttggtgtgtacctaaaactgctcaaaaaaaatctttaacaaaaaagatgaaatgatgatctacaaatacattctaaaatagaaattgcctaaactgaacaataatttggatgtatgcaggtaaagcagagggaaaacaaacaagactgcaaggtgcctatcctgctgcctgtggaacctaaagattaatggtgtgcatcatgatatagctgcctccaacacgactagatgcatgtttttgagtgtctgtgtttgtttattaaaataaagataattgattagttaatgtatttttggatatgtgcaatttgaagtgcttgtaaaagatctactttgtcatgtccagctgatatctggaatgtcagcttgctgcttgggaaagaggtcattacagggcatttaactttgggagacaagtatatatagaggtgatgattgaaaacttgagaacagatgaaaaagagaagaagtatatatacgtatttgaagaacgttaatttttaaagggtgataattgaacaaggggccagtaacatctctcagccaacagagaagtaggatgggaaccagggaagtttttcataaaagggtatagttgagagtttcaaaaagattaaggacttttgactttgacatgtagaaatagactgatgggatatctaattttatatgattttagtggtgtgatgtgagtgaaacccagagtatattctatacaagatagataaatacagatagaaatatagagatagatatagatcaatatatgtatgcaggcacttagattgatacatttttgtcgataaggaaaataatcagagtgggatagaagcatgaagaattatatctgggagtagggattagaccagaacctggggatgttaataatgttaattgggcaaagggaagggattagtcactggagagagattattgcatcaaaaaaatagaataattggtggagcacagaaattggaaggagtgcagtctaagacaggaaagaagagtaagaagcatcacagaagaagggaaggagaactaaaaaacaaaagaacaatgaaaagaagtggggtgaggatcagaggactcaactttatgtgggattccatcttaatgacttaagaagtaccagaatctacaatgaactcaaacaaatttacaagaaaaaaacaaccccatcaaaaagtgggcaaagaacatgaacagacacttctcaaaagaagacatttatgcagccaaaaaacatgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggattgtaaactagttcaaccattgtggaagtcagtgtggtgattcctcagggatctagaactagaaataccatttgacccagccatcccattactggatatatacccaaaggactataaatcaggctgctataaagacacatacacacgtatgtttattgcggcactattcaccatagcaaagacttggaaccaacccaaatgtccaacaacgatagactggattaagaaaatgtggcacatatacaccatggaatactatgcagccataaaaaaaggataagttcatgtcctttgtagggacatagatgaaattgggaatcatcattctcagtaaactatcacaaggacaaaaaaccaaacaccgcatgttctcactcataggtgggaattgaacaatgagaacacatggacacaggaaggggaacatcacactctggggactgttgtggggtggggggagggggcagggatagcattaggagatatacctaatgctaaatgacgagttattgggtgcagcacaccagcatggcacatgtatacatatgtaactaacctgcacattgtgcacatgtaccctaaaacttaaagtataataataataaaataaaatttaaaaaaaaagaagtacaattattcagtggtacttttaaaatattgttgtttaaaactgtaactctcaaaattggctgcatattagaactgtttcaatttcttaaataaaatctgtctaagtgagtccgttatgggtggccaaatcatttaaatacaaacatcttagaatgaagtgctggcatcaatactttaaaagttcctcaggcagaatgctaatagtcaattatcattgagaatcacagtttaagagaattgcagatgtttgcgaatagtgtttatggagcattaattggatagctagctactagtatttaaattgacatcttcaaaatattaaaatctgtatcctgtatagggagtaattgtcttttcaagaaaactagcaatgtgtggattggtattagtggagcatagtatttattagtttcaacctatacgattgcattgacatctgataaaacggtctgcatggaatgaaaaatgaaattatctcatgcagtaattttcccttaaacaaaatatgtgctaataatgtgattatacttcagctccggttacggaagatgatgttggtgctttaaggcatcactcctctaagtgttgttcatgacccatgtgcatgagaatcactccaggctttttgaaaaaatcaagtgtaagagacatatataaagtcagaagctcaatttataactgagaacttataacaaggatctggttaaaactttataaccaactcatttgctccttgcagacagggtagatacttaataagaaaaatatactgtacttaaaaaattgagtatgcactcacatcaggctaaaagagtctcatggctacattgaaaatgacaataattaaaacctgttgcccaagtgtctctttcctttaaagtgctcattgtcacttttgtttctgacactttcagtctttgacatcagtttactaaccacaaagtaaactgatgtatcctgtgtcaggtcaatggggaaaggcagggttgtgatgaggtgtagcatagggacctatgtcatgactcttaaagggtatatgtagatcagagttctgtatcaagtttctttgttttaaaaatattctctcaatgagaactagtttatgtctaggttcttggaggatgttttatagcgagaccattcttctaccacataccagaaataacattaaaatactaattataaagcttaatttgttgacttaaataatttttaaaattgtgggcatgctgacacaaacaacagtctatcttcataatctgcatagttcaggaaaatatataaaagtcttgaaaggcaaggaaatatctgttttacaaagagatacataagggaaattaacttttgtagacttcaaatgaggaaataagcctttgatcccctaaggcaaacatttttgagatacagtttctccatataattgctatgattttcttacttacactttgtagttccctgctggctgtttttctgtgtaaacttactttcatttccaattatgtcattatagagatgaaaatcagctctaattaaataagaacatgacaataattgtcattcatttatttatgtaaactatgatttttctacctgtgaaaaggtgatttagcaaagaaaaatgtagctctcatggtccatcaattgactggaactaatagtcatgtatctacagcttcccattctctcatatctttattcattcaatattacttgtctaagggtcttcctttctttcatcttcaaataagcatttattaagtagctacactatatttattttattttataattttaacttttatttcagattcagggggtacatacgcaagtttattacctgggtatattgcatgatgttgaggtttggggtatgattgattctgtcacccagatactgagtatagtacacaatagttaatttttcaattgtctcttctccctctctccctccatagtagtccccagtgtcttttgttgccatcagcagctaccgtattaaacatctactatatgccatgaactatagatacagatgccacagatacagaaataaactagttacagttttgccctgaaatcaaatgctttaaaacacattcattttattaatgtgacaagtaccataccaatatattaaaaaatttaccatagcagtttgaaacgttttttctctctttaccaaatacacagcagaagctatttacacatagaataaacattccggtgaattcccagtccccaggctatcatgtcaccccttctatagaactcaagaaagcatatcttaattcataaataaaaaataatagcattgaatgatttcttttttctttcacattttgcttgtttgtttgttttttgtgtttttctttttaagacggagtctctctctgtccccaggctggagtgcagtggcgccatcttggttcactgcaatctccacctcctgggttcaagcaattctcctgcctcagcctcccgagtagctgggactacaggcgcatgccgccacgtccggctaatttttttaaaaatttttattttagtagaggtggggtttcaccatattgcccaggctggtctcgagctccttagctcaggcaatccgctcgcctcggcctcccaaagtgctaggattacaggtgtgagccgccatgcccagctgcattgaatgatttctaattttaattaacaattaatgcaaagttggtgatgatttatccttggaataaatatttactgcatggctaatatgtctgccatgtgctggcattacagtggcaaacaagacagccaaagttgctaacctcctgagttttccatttggagtaagggaaagaagaaaataggttaatttcagatatgggctatgaccttgatgagagaggaaaagagagaaaaaaagtgtgtgtgtgtgtgtgtgtgtgtgtgtgtgtttgaaataacttatttaagtgtaataagcacagataatggtaaaaataagataaatcaggaataaagatgttgcctgacttacatgttttcaaagttaccatttactatctaacttaaattttctctgctgtaatgattatattttatctaggtaaccaatatctagtgggattatgcatcaatttactaaggcagttttttgtatttatctccaagtgaaatttaatcaatttctacagtagtgaaaagtaatttgaagatttaatatattcagtattttaataaaatataaactggtcaaatagctatgcttttttttttaaagtaacaaccaagcatttattcacttactacaaatagctatgtttacctctaataaccagttaagtctcctttagagtccatatagatatgcttttatttgtttttggttttttgtttttgtttttgtttttttttgagatggagttttgctcttgttgcccaggctggagtgtgatggcatgatctcagctcaccgcaaccttggcctcccaggttcaagcgattctcctgcctcagcctcctgagtagctgggattacaggcatgcgccaccatacccggctaattttgtatttttagtagagacagcgttggtcaggctggtctcgaactcccgacctcaggtgatccacttgccttggcttcccaaagtgctgggattacaggcgtgagccaccatgcctggcggatatgcttttatttgaaaagtaacagaaatttaaagctatttaaactaattatgctatacaataagtgtgaaatcaatttctgtttcttaagtaatttcttcatgagcatatcgtataatgcacatgtaaataacagctttgagtgtacacttatattatgtgagtagttacctgtatgacactgtccccaggtctcatgtctgtataaacatacacatcataggatatttcagggaaggttggcgtgttatcatttgcatccatcacttgaatattgacgatgactggctcactttcttgtacaccatcaaatgctgttatctttgggaggagaaaaatacacttagtagagatgttctgcaaatataagtagtacagagtttgctcttacagtttaacaagtttcttacaggtaatcttacaatttgaaagggtgcaaaaatattttgttgataaaaggacgtaatagagacgtaatattacatatattaaaagtgttctaatatggtaagaagcaagtattgaagattttgttttaaggtattcaactccaggcatattttaaataatcagatatgcaaaatatcatttaaagtgggccaataacattgctgactcttagggttaactacaatttaatccttaaaaacttaattggaaaatattatttgcatttacatattttgtatacaatagttccttgtacagtcaatgtgtttataccatcaggaaggtagacttcctagatgtactttgtatcacagtaattcacccaatggcaattttcaaaggactaagtggtatcatttaattgtgatattttatactttatcaatgttgataatgtatgttatactttatcaatgttgataatgtacattatcaagattttaacaattcctgccaaatcagtgctacagcaccaccatctttgtctaaatccactttgtatctaacttttaacaatcacataaactttcctggaagttctgatctttttctatgtaggcttctccagaaataatttctacatatcttgtttaacttgtgctttctcttagctcatctttctcctgtgactgattcaaaaattgggatataattagaagttacattttttctttatccaactgtcaaccctactatacttgttatttacgtgtttgtgtgcatgtgtgtgtatgtttatgtgtgtgtgtgtatttccctatctcatgataaatatttacaatcacaactttaataacctttactttttttcccccttgattagcctaacccatgatttatctacctcagtgctattgacaccttgggacagataactctttattgtgaggggctgttctctgtattacaattagcagcatcctttatgtctacctactagatgcctatagtaactaccccttcacaattgtgacaaacaaaaatgcctccagatgttgctaaatgttcactggagggaaaatttattccctcttgagaatcactggctcaaccttatgactaaataaaaaatgcaagaacaacaacaaaaaaggttaggaaataattctttatacctcaatttaagacaattatgactgtttagtaaagactgaaattctcactttcttttttttttgaaaagttttttcttctgtgaggaagaatgttaatatagctacacaaattacaaaaaaagagcaatacatgtaaataatttttcattgatcttctctctggtattgaaaataatgtatttttcccccaagtcattgattttttcagttttaaccagacatctctttcagttccatacaaacatacatacatacattcatacatacatatgtatatttacacaaaagctctttaccgaaaaggtgtaagtttgctgttcttccctgtccactggttgaagtaaggtgaggtagcgagtaataccagtctgtgtgacggtgaagactgaggtgtagtcattcagaaaaaggtgaagctctgggtcttttgtctttgaaaaaaaatgacatcgtttcaaacgttgaataaataatgtagctattagttcattacctagaagttaatgtttgaaatttatagcaaaaatccacgtgaaagtattaagaatttctaacgataaaagatatttaactagatatttactcaaatgatctaaactattcaaaagatggtgacctatatcgtggaatacaaaatactgaaatacaaacaggtataatcaatgtgggaaaaaaggaaaaataatagaaaaacagaaagaatataaaaactcccaattaaatatattcttactgattatttgttatcaatattttccaaaatagcattggactggagaaataagaaataaaagcaagaaaagaaaattgcatttcaaaattttagcaataagactttataattacttcatttatagtaataaactgcatatatacatattactatcttgttcttacttataatgcaaaatagaaataaaattggttatgtattattcattacctataaatatcatgcttactctttcttattttaatgctgtaaaattttccaaatggaaacatgtttactttaattaaaatatttcagataatttgatttaaaatatgcataaatttagcaaatgtgtctgatagaaaagtctagaaaaaatgatatatacttaaaaaggaagggatttcaaaattcaagtctgagagacaatcaacttagcattgaagaccctttgcaatttcattgccacccctgaaacagaagacaacatactctaatttagagaaagaacagcaatataaagtaagaaggctagcactgatgtctgcatagtaggaaagaaaggcaggtggagcgaagaaaaaaggaatattcagagagtggactattatgaaggctttgaaaaagagagaaaggagtgatacagggaggtaaggtgttgttctagattatactatcttttaaagtatgcatagcatgatatgaaatggatttaatatcataaaacacttctttaagtctgatgtcaaggactgaggcaagagcaaagaatagaaaattgttaaatgtgtttaatttgaaaataatagaactcataatttcaaaatttctatgtaaaatacaaaagttgtaatgcacactactataataaaatgtgaacatgatttgatccacaatatacttgaatctgcccatcttttaaacattgtgatatgtgtagatttcaaataaccttgaaataaatggtttcatttgaacctaaaacaagttatgtattcataatatctcattctgtagtagcttctatgttcaggattttgacttaaggtcactgtgctacatttatcctggaacaataagaaagtaatactacacataataattccaactggcgtatttattataaaatgatcaaaaatattgagaaaaagttcaagaggcttcacactctgatattttcaaacaggcacttcagttgtttccatttcagtgtcatgaacccaattactcagataactagaaagcgggatattctaaaaaatctaacatgttagttttaaaaataaattatgtatttttaaaagtcaattagaaaatgcatatgtctattctgaatgatattttaagcattcttattttacactttagagtgaattgtgattaaattcaattattagagttgataaaaaagttttagttaacatgcagtttcagtcaaagaaactctaagtatgaatgtctgccatttgttttgtgttcatcctggatttacctaatcactgggcttttaagcacatatacacttctctaaatgcaccaacaatggtgccatctggcatgccttaatttattcggacctttaaaccctaaatgcaagctgaggaagttttgctatgtaccttgtttaccaaatatttactttgttccttttgttcaaatctcatcattctctacttcctttataccttaattctctcaatttattttcttcctttcaaccgtaacctctgttaataaatttgttaggtatattcactcatatcttcacatttttaagcatttttgtgtgtcaagtatttcgataatgcaatatttcaataagtattgagttgtcaactagtgtgtccaaatgtgactgtagtataatatgtttgtgtcacaaagagcacttactttttaccactttcaagaaaacctctaggttttgtttgtcaaatgcttttcgtttgaagataatgcacacatcaatactccataaatagacttccttatattggataaacagaaacattaaagatcttttgttaatttaactgtctcagtttcttgagtgcttttataataactagctggagaaagataacatttcccagaactacagtgtatttgctttttgtgaagaagataatctatcacagaaagctagcactatacatggcatattatagctcattctgttttgtttagttaatctctgatcaaaatataacatttacatttatgtatatttaaaataataatcttgtacataaatgctactggtaaatatcctcgtattaatttaagtaaaaaaatttaggaagccagatttggaaatgttcaacaaattgtcactcaatgtttaataatttatattcatttttaaagatagtgcaagtttcaaatgttgtgtatatatttatgttccaaatattacagcatatcattttatgagttttatgaaaattttaagtaatatcaacataaaatgttaatagatacatatcagtaccaactaacctattgttttgattgacaatatttacagttcaaggttttgctacccttcacaagaaaggtgtatcaaaggtttggtaagaaacaatgtgcatttgaagtcaaatatccttctctaaatctctttataaacttaaattccttcttgtcaagctgcattccgatacagtttgaatttcacaaatatatttgaattttgcaattcctaaagagtaacttgagtcaacacttgtatatttgcaactcttttaatcatgttagagttaatagcttataagtttcatagactaggatgtacatggacaaataatgctctggcttaatattccaataggggtagcagactttaggtagctgttgtgtctataagtttatttaaaatgaatttaagtgttaaatcaataggtacacagagagttgattaaaaaccgttaattttcctctgacattaggtaatatttattttaccctaaaatatccagtcagtatataccaaaagtatgatatattaattcacttatctgcatattatattttgagatggtaaaataagctctgacatgcacacataaaaacagaaaaaaatgcaaaagtaaatgcatatgaaaacacacaggtaaacaaacatatgaatataaaataaacaagcattctatcatataaaactatgttcaaagatgagagtctactgtttaaacaccaacttggggtttctaatgggaataaatataggatatcacaaacacacaagaccatatgcatgcacatatataggcacatacaacacagacatgtatagacatatgtgcacatatatatgtatgcatatacaagagcatacatataaatgacaaagcataagagaaaaatgacaaaaaaatgttatctcctcagccagttttaattacttggtagtagttgcctgagtatttagttcaaaaaaattcaatttcaaacttacaatgttttagaaaaaatgccatgataaattaccaatgtttgttgtggactgagaaaacattaataattaagcagtctttgcctcagttgacaattaaatttggattttacaaaatttcatagtactataaacaatagattatgtaaatatttttaccttttttaactttaaaatatttttaaattttaaaccaatgaagtaagtatatttaaatttatataaagtatttgtagatatccttataagggataatgaagtaatacctacgtgttttagtgaagaaaaaaaagaacaaggaaataaaccacagcaattaacaaaagaacaatcacaagcttaacacctagtacctacaggaactccactgggtggaacctatacgcaaattaaacatgaaataaatattgtaaatgtaaatgatcacaaccgcacatatgaagaaaaagcaaaccacttccagcacactagactgacaatttttttcagagtatacaatttttttattagcattgtgacccacatataatggaataacgatatttatgaagcatataaatacttaactgctttatgagtatattgaattaaatatcaaagatacctcttcatagtaaaataacgttaagcagagaaacaaatttacatgaagttataaataagtatctttttacaagccaaatgagtaatctttattgattattattctttgtcattttttatgatcagcattcaataatcaatttttagcatctctgacactgaaaacctggtggtctcagacatgcctcttaacaccttgtgccttacctattctacttatattatgggttattttgaaattatgatgtggtacaagtactctaaaaggcataatgtataaactgatatggttcatatatgtatacatgcatgtgtatgtgtgtgtgtgtgtgtgtgtgtgtgtgtgtgtgtgtatgggtatatgtctacatctatatagcaataaaaagaacactggtgcaaatatttcttttcctttcttttcagtattactgtggcccttggaattctttctgacttaaaatctacactgtgaatactatcacaactcacattcctggctattgtttcttaaaatgtggcttcactttccactaaattaaagggagaaacacaacttaaattttacgcaaatggatccaaacttgtccccttcttggcatttaccatctggaatagctatgcttgaagcaactcttgagagccaagccctgcaatgacaacttccacttttatgcttgaggcttaatctctaatactatgctgatattgtatgaggtggcacactgtctctctcaaagagtttatccctataatgatgattgtcactaattctgacactcaaaagcaacaggattttgtttcattttgttgaattagggtcccaatttgtcatctagcctgcagtgcagtggtgcaatcatggctcactgcagcctcgaaccagtgggctcaagggatccttctgcctcagcctttcaattagtgagactacaagcatgaaccaccatgcctggctaagttttttgtttatttttgtagagactgcatctccatatgtagccaaggctggtctggaactcctggcctcaagccatcctccagcctcactctcccaaaatgctgagattatgagtgagccaccacacccagccaagagtggcatgatttaccttgaagtaaaattcatgcccataaactaaaatggctttaaagttttcttttcataatacagatcttttgaaaatcccagaaatgaactaatttactttataaaaataaatggtgctcggtctataaaaaacagatgtatcagaaggacataaatccatcttctaatatatgaatgactatttcatagatttattttgtgtgctggcaaatggaagatttaaggaataatagatgaattaaaagaaaactggtttcaactcagtatgaaaaacagctttctaagaattagagttgttcaaacatgggataggccatcttgtgaaatacttaatgcaacatcattagcatctttgaagcatctgttagataacctaattcattcaatagtgactgaatttatgagtttattgaagagttcccaaaccctattaagtgctggaaactgtgttagttcttcagcatacaaaagttgctaagatataggacctattctcaacagatgtaaactcatgagggagaaagacattattttcaagttggaagtatagaattagagaaatgcactgagggaggcatgcaactaaaattggataatgaataccgtggaaagattctcgaatgaaggaatgcctgaggtgagctctaaacactgagtataagttatccaagccagcctgtgcaacagatgaaagatttcaaagcctagaacatgtaatgagcaaacattagacaagatgtagcttggcacatgaaagaaacgacaagcagttgccaaatgttataggtgaattaggaagtttccaaaactcaggccacaaaaatgttcaggtatcaagatacagaaaattgtgtgagcttaaattttcttctctagaggaataggtgtcataaaagtatatcaaatagaaatgtgggccagacgcagtggctcatgcctgtaaacccgagcaaggtgggtgtatcacttgaggtcaggagttccagaccaacctggccaacatggtgaaacactgtctctacaaaaaatgcaaaaaaaaaaaaaaaaaaaattagctaggcatggtggtacaagcctgtaatcccagctacttaggaggctgttgtgggagaatcacttgagccagggaggcagaggttgcagtgagcctggattgtgacgctgcactccagcctgggtgacagagagaaactctctcaaaagaaagaaaagcaagggaaagaaaaaaaagaaaagaaagaaggagaaggaggggaaggaagggacggggggaaggaaaggaagggagagagaaagaaaaaaataatgaacggagagaaggaaggaaggcaggaaggcaggcaggcagaaggaaagaagaaagaaacaaaggaaggaaggaagaaagaaaaaaaaaaaagaaagaaagaaagagaaagagaaagaaagaaagaaaaagaaagaaagaaagaaaaagaaagagaaagaaagaaaggaaagaaggaaggaaggaaaaagagaaagaaaggagagggagagagggagagaggaaggaaggatgtagttagatgttagatttgagcttttgaataaatcactctaatggccctgcagaagatagacttgagtaagaaatcaagagaccaagaacatcaggaagtaattctaataacagaccaatagggtggtggttataaggatagagagaagaaaagagattaaataaataattaggggacaaaataggaagatctggaagatttcttagttgtggcgaataaagaaaacataaaaatcaagcaagacttctaggattctaggttgcatagcacaataaaacatctatcaatttctgggaaatgggttttaggagaggatttcatacagtactggaagtttaaactatttctaatattctatgagcttatttatattttatatatagaaactacatatgatatttttaaaaattttattactagaagactaggcatacttgttcactctctggacacctaatgacagtcactcaccatagattattttagaaagggggtgagtctaagtaataaacaaatgatcagttttgctgattaattacttgacacttttataaaagttatgaagcatgccaccctccatgtacatggcatcatctcagggaaattttctctccatgccctttcctaccagtcccaactaaagacacataccaaggcagcaatgattgctaccatatagatgactggacaagagggggcacctgatgagtatgaaactcacaatgttatacagctattacatgacagaaccaggagtcaagccaagatctgtctaaatccaaagcccaaactgccaaaaacacttcagagcatttcatagactaactggtactgtacatctccaagagttgaattataagtagtgtttctcaaaggttttagacccctgagctctctccactttatttcatcaatgccctgtgagtactactgtcttttacaaagttccttggaacacaattttaacatttgtaatttaaaagtgaacagacaatccagacaagtacggggtcacataggcaagcatagggcttagtgtgtaaccaatagataatatgaacacactgagaaggtataaatacataaattttgctattgtgtaaacttaaaactacctaactttagatttagatttttctaaccaccagttctattaaggtatgacctaagctatcatacactttcaaattgattagtcactacttaaaatatgagtatgtattcaattgaaaagcaaaatccgcactaaaatttgtgggacattagtagatctacaaaatacatttgctcagcctggattgaagttattaaggtgactctaggtgttttctagtggggattcagtagagacttttttcctgtgactcatgaaacccactatacatcagagaatccctaaattctcttgactggcatatgaaactgtgtatagattaatgtgttcacttttctaggaaaagaacctagagcattcttcagctatcattatagtcagactatgatcaaagtatataaaatatagagtgcttaaaattgagaactttgttttccataaaccttggcttaaggtccatttctactgtttactaacactgtgatcatggtaaggcatttaaactagctttaatatccctttctgaaatagggataattgcatctatcatgtttgttgtgagatttaagggaattaatgcaagaagaatttactgtattgtttgacatgtactgagaactcaatgacagatattgttaaaacttgtggtttaagaagacactaaatgtgagagaccaggaaagattgaaaaaaaaaaaaaagctagaatggaaaaagaaaacaaagcaaagagaaacaaaagaataaaataaagcatctggtgggaagaggtggagtgccaacaagaattgtcatagcctctgtggagtgttacaaaatttatttagaaagagaaaaaaaatctgaaagtgccttcctaatttcctgaagtgattataaagctatgtgtaatgagatattagggaacattctagagctctgctgccttatgagtgacatgtatttatatttaatttcattaatattaagcaaaatttaaaagttatgtttttagtccagttaaattttaagtactcaatagctgtataagactagtggctactatgttggacagtacagttacacagtaattccatcatcacaaaaaaatccatctatctgagagcaagcactgttaagggagaaatgaatgaatcaagaattatataacagcaagtaagaaatccaactatcttttacatatagttatgcttataatccaaacacagttgtatttacttgctgttttatatatatgtgtgtgtgtgtgtgtgtatgtatacctgtgtatatatctctatctatctatctatctatctatctatctatctatctatatctgtatgtgtatgtatacctgtgtatatgtctatctatctatctatctatatatatacacaaaacatatgtatacatatttatgcagtgaggatactgtggtagttcacaaactcaaaggaaaatctttgggaattagaatacctctggggaacttaaaacttaaaagacaggcactcaatgggactctcttttctgtgtgtatctctcaggcttcattctctcccactgataattggctttctcatgatgtcagcaaatgtggctacaaaggtttcagattcatttccacttctctaatacatgataccaaagtctttcagcccttctgttctccattgtaaattcctgggaggattctggctagcctggtatagattttctgtccctttataacattcactctggctaaggaggtaaagtgttctgatttgctcagcctggaccatttcccactcatgtagatagtgtgagtacaagaaaaacaaaagacaatgatttgtggagtgaagcgtaagcatccacatagtcactggcagaagtatgaatgggtcagctgcctcaaatatattttaataacgatgccctcagacttgaagaaaagtctctgagaatcacaatctaggggtgctttcatgattttttactcatgtagtaacaccattatttttgctttatcaataattatataaaacagttctcaacatatgttaataaaaatattgccctcgtcattaaataaacatcaagtaaaacattcattttcttacatatactgaatatctgcaagctgaaaaggaatagttattgaattcaaagatactttttaaaatatccttgttttggaattaaattataacactaaaactcacttacagtgacttaattctctcttctctagcttatgtagccatatctttgtcatatttcccattaatggaaatatgagatttgttacacaaacaagagcaaaatatgtatttaacttacatcttctatgtccttgtccagagctactattcttaaaggtgaagtcaaattgagactgtccgaaatggttgctcccactggggcagattccaggatatagccttgataactgggcattgtaaaatatggactttgattgttttcatccagtatttcaatgtgtagaccggcaaaggcaggaagaggatgaccattgtcttgttcagcctaaaattgaaaagaaaagaaaatatttagaaagtatatgtcgtgctatctttttggagtttcacttttcatgcaatatatagggttctctttttaactaatatcatcacataaggaaaaaatacgttaaagggccatttgaaaatataaatgaggaaatgaaaatccagtgaggcttaattgcttcagtcttctgttttaaaactcagtgtatattttaaaaattcactgtaataaattattattattttattttatgtttttattttttgagacagagtcttgctctgtcgcccaggctggagtgcagtggagtgaactcggctcactgccagctcttcctcctgagttcacgccattctcctgcctcagcctcccaagtagctgggactacaggcgcccaccaccacgcatggctaatgttttgtatttttagtagagacagggtttcaccgtgttagccaggatgctctcgatctcctgacctcgtgatccgcccgcctcagcctcccaaagtgctgggattacaggcgtgagccaccgcgcccagccaaattattgtaatttttattgaatgcagtaggagaggtaattgtgtttaaatacatttagtcagaaaattcaaatggagatacttgagtgtaccgctgataaaatatttaaataaaagaaaaaaagtaacacaaataaagaactatcgtatcgactttgtctcttctgtgtcttctcattttacactaatgtttaaatctctgctatggtctctgctgttgtaccccccaaattcgtaagttgaaattttaaccccaaaggtgatggtattaagaggtgtggcatttggaaggtgataaggtggtgagggcagagccctcattaatggggtgaatgcccttatagaaaagggtctagagggctccttttccccgcctcccaccacgtgagaacaagtaagaaggtggaaccaccctctgtgaggaagtgggccctcactagaaaccaaatttacaagagtcgaatgtccagcctccacgactgtgagaaataaatgttccttgtttataagccatccagtttatggtgttttgttattgcagctcaaagaaacgtagacaattcccaaataattcgtaattctatataaaattaataaagttatatttattgcccactgaccgtccccaaaagcttcttaaaaaggacagaaataataaatttcattgtaatgttgtagaaactgtgaattgcaatattatttaactagaaatgtttttcaagtaaaattaatattcttatgtataaattttcttttttttctcccattaagtttaagaagttgataaaaatttctgtttctaacacattttcatacaaaatctctacatggtcatgctgcacataggaaaatactaaccatagattttctgttttttaaaaaatatatattttattatatgtgtattggaaggtttaatttaaaggaagatttcatcacaattgacttctggaaaatctcctccaacttttatgagaaaacatggatataatttaatagcatatacatttattaaaatgaattcaaattctatctttaatttttgttatgttttccccattgggagaaaagttgtatttttaaatcaattaaaatgaaaataaaatatttgatattaaactctggtgtgattttctagatagatagtgacagtactttgtaagtagctcagctagagatctctaactgttaaaacgtgaggaaagaaatttggtctccagaagacaatttttcacttccttctaatagtaatttaacattttcatctgttaaaaaggtaggtaacaaactacagtgatattggtagggattgctgacttttcaccaagaaatattacaatatattttccttcatattatttatattgaagatttgttgaaatattatttatgtcaattactaatgtgaaattatgctaattaataaacccatagggaggtaatgtcatataatgcattgattaaaaaacttatatttgatttttaatatattgatatctctatttagataatatgctagattttcttagtaatattacatagtttaccttatgcatttaacttttcatttggcagcagaatgtcaaattagcccatggcacaaaacgctttaagatcctgctcagcactaagaagaacagtactggaataatgtttggtcctgtctgggattatgtatccatctcacataaccaggcatgctgctaataccatcagtatggatgaggtctttctgcatccagcagttgtgattaatttgtgccgagcgatggatgttcttttaggagttacccctgtgacacacatcaggctttctggagacagctgaccagggcaagaggtagagtctacgcctggaaaacattgttttttcactgtttaaaactaattggtccatatgggcttccaacccaatgaccttgaaatgatttaagcaggaatcctctgcttcactcttacaggctcagagcagttcatacatgcaaggcattttgaacagatttttttctctctttcttgtatctctccatctttctttaatatctaattattcttttttttttttttttttttttttgagacaaagtctcgctctgtcgcccaggctggagtgcagtggcgggatctcggctcactgcaagctccgcctcccgggttcacgccattctcctgcctcagcctcccaagtagttgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaataaccagcatgtcatatccaggacataaaaatgctatgaaaagtcataaattctacaacttttcctctttccccgatgaacacacccaaacacacacaatatataggtggtgaggaggatgaaaaaagcaaaattgtataataatgaaataagcttacattttacattcagatcatatatcattagtttttaccagcagctgtgaagccagtaaaaatatgtattatttgcatgatgaaaacaaagtgattcaatgaaaagagaaataaaattcaaatcagatctatgaagataatctaattcttaacttcctcatatctataaaaattacatataaaggctctgcccatttttactctaatattaatttagagttaataatgattaatatttttggattgctactatgtattttgttctatttgaggtgtttcaatttgctgaccagatatctgtctccaaagcccactttctttatgccatttatctgtccagatgtgaaaatgtgtatttttgaactgatggaaaaaaagaaaggttagttttatattcaaggccacataggctgtaagttacatacagaacatgggcccagactcaggtctcctgatttttaagaggctacacaggaagattcatcatatgtttctcaaatttacagaatgcaaatgaatatcgaaaagcaagagagatgggacaaattaacagtaggaaaaaatattgagataaatacttctgttaagtaagagttaaaatgttgaatttaaacaacaacaacaacaataataataataataataataataatatactttgctcgttagtgggcccatgcatcaaaactctgatacaattatcttttcttccatacaatataaataagggttctcaaaaatctgaattattctgttcccctgaaatccgtggtggatgaaatgagaaatattttaaaaacacctcagttggaataaggtggtattttaaaaatcatttactttcataaggtaaccttatttatatttacagagtctatagttacgagttaaacattatatttaagtgctaggttttgtttgaaaagcgtctgggcatgagtctcactttcagtaacgagaccaaagtaaaactgaagccaaaaaaaatgaagtataaaaagcacaccattttgttactttggaaggcaaaacattgaaaaagacaaaccactccatcttcaatattgaaaaaaggaaatactgataatttctgagcaccttgtaacggaggactgagactacagaataactttgttcttcctaactggtggcaaacaatttaacaatttcataatctctaatatgaaacctttcaagtagattcaacaatttaaaaaagacaatggtaaagcttatcaaattatttatcatttaaataaattctaggatagaagaaagaaatcatgttttccaggaattatttattgtgcatctacagagcccactttttttttttttttttttttgtattttaaattctgggatacatgtgcagaatgtgcaggtttgttacgtacgcatacacgtcccatggtggtttgctgtgcccatcaaccagtcatctacattaggtatttctcctaatgctatccctccctaggcccccaccctcgacaggccccggtgtgtgatgttcccctccctgtgtccatatgttcttattgctcaactcccacttcttagatcgcaagtgctcaccttcatctgtattcaccctcccaagttttcttaaacccacttcaatcatacttttgcctcagccactcaaagccagctgcttttgtcaaaatcaccggtgccttttacattgctaaaagcaatatttattttcagtccttatcttacttgacctatcttcagcattattcactatcctttcacggcaacagcttctcggttctcttcctattttactacccattttttctcattctcgtttggtggtttccccttttctcccctacttaattttggagtggcccagaagtgaggagttattcatcttttctttatactcactcccttgctcaatctagtctaatctcacaccttaaaaatgtcagtactattatgactcctaatttcaatctccaacctggatttctcctttgaattccacagtccatatccaactgtgtacttcgtaacactgcgtaagtatctaacagacgtttcagatataaatacctgcaacaatgaaattctgattaccctgcacgaacctcctccactcatggtcttttccacttctttaatggcagctacatagttacaggtaccgaaaacaagaaacttggaggcacctcttgcttcagtggatagatatggaaaaagtgaaaaccacttttttgaaaattgaatttgaagttccatcttctcatttcacaatacagtattagcagattatatatgccaagaaatattctatgttagtaaacttgagatgaaaaaatactcttatgtcaatgtagtgaattatggtcttatcctactgaagcattaaaggtaaatattgcaattttcaaagttaaggtaataccacattttaatttggataatattataaatttatgaaatatttttctatatttataatatgtaaaaatagaaatataatcatattgcttgtatagtaaattccactgttctatgctattgtaaacctaaacctttcttgtaattagtctgaatctcatttttcattagatttttaaattccatgagcataaacactgtaaatgtatcagtttcattcactgctaaaatttcggacaatccctggtatatggaagaaggtcaaatatatatttatttttacttttctgtatctttaattttaataggctttaaatatttttttaaaaattaagtgattgtgacatcattctaattcccattcgatagatatttatggatgtttttccagtgtgtgtgtgtgaacgtacacgaagtggaaattaattaatgtgaatgtacaacatgaacaccttagattatagaatgtctttattcacacattttaaaggtttgtgatatctgcaagtttacctatgggtaattaatactgatgcacattcttgccagtcttatgaatgggcctcacccagccccctcaatcatcaattatgattctatatctatagggatggtgctgtgaacagaataacgtataatcttctagaaggtttatgcatttacatgtaatatttatgcaaaaaggcctatttatatgcatttttgaatggacagtggcttaaagaatgagatgttagttgtgactttgctcttaacacatggcttagatacattttattgtcagaatggtgcaaattgaggactttagcatgattttgactgtgtgtactcttccagtccactcaacacattttaatttattaatttaatttacttgctttacttactgaactatagcttttaatacctagttcttagaacctgcttggccaattttcgcaaacattagatatcttaggaagagaaaaaaaaaagagggagggaggaagaaaaagagggaataaaggatggatagagggagtgggtaaggaaaacaaatggcattctcctttcaccagaggtaagggacagataaatgttaaaaatcatggcaaccacacaaggcaatcattctcaaactctgatgtacctaagaatagaatggaaggcctaataaaaagcagattccctgggccaggcgcagtgtctcacgcctgtaatcctaacactttgggaggctgaggcaggtggatcaccagaggtcgggagttcgagaccagcctgaccaatgtagagaaaccctgtgtctactaaaaatacacaattagccgggcatggcgctgcatgcctgtaatgccagctactcgggaggctgaggcagaagaatcgcttgaacccgggaggcagaggttgcagtgagccaagattgcgccactacattccagcctgagcaacaagagcgaaaccccacctcaaaaaaaaaaaaaaaaaaagtagtttcccacaccctatccacaaagattctcgttcatatgttgatgttagaggcaaggaatctccatttttatcaaactgtctgtggtggttataatgtgagcagaatgtactttcacagacattattctgggtgtggctactcaaactccaatttttagagaatctttctttttagccctattggttagggctattggttagccctattggttagtggaccagtctttactaatggatagtccttataatctggagcaaaaactccagataatacagtgcatccaagagccaatgttgtcacgccagaagatttggagtctagtaactgaaactgcatgcaattatacaattatcaactgtgtaggttcaacaccactaaaattgtcatgtgactctagcattaccaaagattgctcgtgtgtcagtgggaatactctacaagtaataagctcagtcttagctagtattcataggtcatggtcaaatcctcttgacattccattattcataattaattagaatttaggtatgttggtgtatgtgtgcacgtatgcctgtgtatacacagtatcaatatagttttgggtgtaagccaccacttttactttatcatttttaaataaaggaacctcagattgagaaaaaaagcagagagaaggtaatttgacatacagaaagtttttggtttctagtcagagtcagagaaagacaaacgcatatagaatgtacccggaaggcagataatgacaacattctgagtaatagtatattcctgttgctagtgactaaacataggatataaggctactatgtaattcaaaattttcttcttcctgtgttcccttcctggacaccacacctcttgctaaacagctcttcagtaaagccttcaatatacaagggtgtaatttttccaagtttcttcacccagcaaggtgcaggctgcatattgatctttatatgaggatgattctgaaaaacgggcaaattgaccgaactaccaatgattcacgcatatccctttattcctttattttcaattttaaattcaactctcaagtagacaaagaagattgtttgctttggttaattttgctggagggctaaattatatatcctgtctttctttatggatagaaattgcatttgcttaacattttaaaaatcactttagacagttaaaatatgtttacttaagctttcaaccaatttattttttggcaataacaatattattagtgtataaccttcaaatagcctgacatttggacatgtttgtcttgggattcaaacgtgaattacttgtacttttattttgaaatcaaaatgttaataaaagtctcagatttttctttagcagacaattcattgccattgaattttttcacaggtggaaagtatatggttgtggaacatatacatcctgagttggttacagtacagaaaaatagaaggaatcataaaactcttaagaatctgattaaaaacatcaacatttaatccaattataaagtgttgcaaaaaaaaaaagagaaaagtaatctatgctgttagaatcctatagtggaagtttgtggttgtgtcaggtggaggtaaggtgattagtgactaggaggaggtgtaggaggcgtatgggatgtttgtagcatctttttttaacaaaaatctggttgttagttacatgattaacttcactctgtgaaaattcatcaagatatacactttcctgtatgtcagcagcatgtcagcatttcaataaaaatgttactaaaaaaataagctatgaacttgctccccaaaaaagtgtacatagactatcccttcctctcctatcacagtaaactaggatacgggcgctcaagtccaagtggtaatttaatagcagctgccctaggaagtgacatggaaaaccaacattatgaagatacgtgaaaattaaagatgctcccctcttcaaccatctgtgttcattaaagatggaccccaaaagtaaacttggccttttgcactttcccactaagtgtttcccaaatactgtggtttccaaagccctgcttcttatctgctgccttaaaataatctaaggtaattgttaaagcaaattcccaggggctcaaccaaaatatctgacatgtatctgctgtattgcttatttgttttctttattagtttaattttatcatatcttcctaagttttcaagtaattttaatatatgacttgctctcaaaatttagcatccgaaaatcacatgtaaatcttgattctgtagggagagccctgaagtctgcctttccaaaacagccacatcccctggtcctggatatgtagaatcagtagtcgtttgggatcagttggatcaggcattttagcttctctcacacaggcttataggtagctgttacactaaaaaagcctagggtgagcagctgaggccaactctgttctagccttttatgtaagtcattatcactcttcttcactttcagcaaagtctcttaatttggacttagttggaaactgaatggaaggaattcatttatgtaagggaattctctgtaggatcctgcagctcactgaagctctacaaaagctataggtccaaagcaacagtaattggtaacaggttatcaggttatatttcctttgtgtgtgtgtgtgtgtgtgtgtgtgtgtgtgtgtaaaatgtcttagggagggatgactgtgaataacctgtgctccatgaatcaatgaacatattatcaactgactaaaaattattaggtttttgccattaaaagtaatggcaaacaccacaattatgtttgcatcatcctaataaaaataagaatatcccattgattcttgaccctacttataaaattaactgccttaaaacctacaggagcctccttttattcaaaatttaatactctaaaaattaaaggatgcatatacagtttgactttaagccaatttattactattactaaacatactcaaaaacttataaataaattcaaaaacctataaaattcatgagataaaatacaaataactgttgtatgctgtaaagtttgtttgcaaggctatacagcaaaagagtatattcttggttggaaacaaatacctttttttgtatgacaaaaaggaaaagaaacttcactagatagaatataggcagcacatattttataaagccttgtaatataacgacgaaataatactgacacatttcacacctagggaatatttttaataaaacgaaatactttctatcttcacttcaagtaagaatatgcccattctgtttataacttgttacaacgaacacatgaatcctcaaagctcttgtatacctttcaatgataaaaatctttctttttgcttagagcatgagatacaaatcgacactggaatgactaaaaggattttgaatgatttaaagaaaaaataaccttgccactctggggaagaccacagattctgaaaactctcacttatcaccgacatgttgaactatttagctggtgtttggaacgtgagaatcatcttgggtataaacagcaaggtcagccagatataaaattctgatagtgataaaggggtaactttttttctgtgaatcttccaacttatgttttatttttattattttatcctgccttttgccttccaaccagcaaagccatcttatcctacactgaggtctgatcccattcccagttttttgtcaaccaagagaaaaccacactaaagtaccttctatgaattagccaaccagaataatgtattttgtaataagcaaattttaaaaaatcattaacataaaaattatatctaaatcgtttatttttcagagcctagaaggtattgagggtgagaggtcaatatttctcctccacctactggaccgttcttgagacaaaaaataacaaagagttttagcctacaagtttttcaatatgctctttcattgttatatttctatggaaccaagaaacctatgaagaacgattactcgggaacatatgtgatagagtgctaaggatgtttatgtgtgtggggattgcagagtggggagacgtgacaagggttcagaaagtgcctttcctttgaacattttacaatgtttggtcttgctcttgtactcttacaatgacctttgcagacaagaaggccttggcaaaaagcaaggtactctgatgagaatggataaattgcctttcttcttcccaagcagttacaggtcaccttgtgaggaagaaaaaaggccaaataaaatgtcacctctgtgtgtcttttgtcagtttgtgctttttgacagccactatattcaactgctacattctatttctgttctaacactgctgcatgaataacgatatgagacaagaggacatcatacttcctttccttttattagcttccataattggcataatagttaattaatttaggccagtacttagaattgttagagacaaaccagtggaaaataaaaacacacggtgttctttctgaagaaacacaaatactgttttgttttgtgtgtgtgtgtatgtgtgtgtgtgtgtgtgtgtgtgtgtgtgttttggtattatttattatttcctagtaatggtagtgttgctcttcggcaatatttttgctttgattaaacttaactcattaaaacaaaagttgtaaaaggtaaagtttttagactgacttctttttgagcttctacatcctctgtgatgtatctcagtatgttatctgagtcaaattgttgctgttctcatgatgtgttgttggatatggtatcaggcaccctgtggaggaactctctggtgggaggtggtgtacaacgtcacactgtagcagaaaacctgaaggatactcttagctgccttctctggcatttgatcccttagttctatccaagtgtatcactttatccttaggcagattaaatttcatattatacctctgagctcatttacttactctgttacacttaaggtaaaacagatatagtcatttgtcttaaccattccctcttatttagtgatatgttcaaatttcctaacataaaggcttttcttcatcattaattagaagcattagtgatcttatatagagagtctcgtggaatatagttttctcccaaattcttcttggccctccatttttaagccagttgataacatccccttttgttagttggatgctatgacatatcatgacaaaaattatgctttgtgtggcaatctgctaagtttaaaaaaaaggagaacacaaaattaaaatacgaacacttagtgtatcaaaggtcaattgatttcagaaattgtaatatttgttggaaattcatggaaagattgctatttcattactaataacaagtaatgcctgaaatttctgtggggtgattttctctaaaatgtgtaagagatatttactttgccttaccttagagacctggctattggggtagaaaagataaacttattatattatttagtaacctactgaactgaggtgtggtgtgcaatggacttaatatttgtatctctccaaattcatatgttgaaatcctaatccacaatgtaatgcaattaggagaggtaattaagtcatgagaatagaggtctcataaaagtagttagtgtccttacaaaaggtaccccagaaagctctctcaccctctcaccctctcatcctctcatcctctttccaccaagtgaagatacaaacagaatttggcaatctgcaacccagaaaaggaacctaactagaacccgaccatattgagtatgaaattccagcctccggaagagtgagaaatatatttctgttgtttataatccacccagtcttttgtactttgttagagtggcctgaactgactagtacgtgtctgtgtgtgtgtgcgtgtgcgtgtgcatgtgtgtttgtgtgtgtttcattcttgccataagaataagagtaggaatatattgctagaatatttccagatatagaagatatgtcatttgtagcatttgtcttccttcttgtagcttggcaatagcagccctgatgttttttctcttgtcctaactctgggtcactatggaccctgttcaacctcaccttaaaggagtgccaatcgtttccatctcttgtctttttttttcctctctctctctcttttgtttgaaaactgatgatatacacattagagtagaaagaatataacttatatttcacatctccataacagatttaattaattttattagctttttcattttcacggtaggttccatctttttcattttgagaagtgatgactgatgatctttgacttgctactctgcctgacttagacacctgtgatctttcaacttgacaacatctctgtgggaaattcaggtagggggcaaattgtaaattggcttgaaggcaacatgcagcagcatgatctattttttgttgttttagcgatactctgttggcagtgtgaaaagatggacaagatgcacagaaatgaagcatgattttagagactgcttgtgtaagatcatgggccaagagaatgcgaaataaagaattgcagtagatgagcagagttgagatattcaagaggatttcaaaggtatcaggaagggattctatgagtgactgagtgggaacatacgagagaagagacctttgaggaagtggaagtgtctagcttgagtgggtgaccaactaaaatatgattaactgaaaaagggaatagaaaatagaaggtttggaatttttaaaggatgtatatagtttgctatatttttaatttgtcacaattaaataatactaggagtagttatccaaccaataattgaaaagatgtccgtaggcatcagaagtaaaatatgtctcctcagaccaagaaaaatgccaggcacctgagaagcattcaacaaggattagggaaattgaaaactagcaaatgtcatatgctttaaaatcattgaatcagggtgttctcttaaatttctatgaagtaaaatatgatttttatcattactcaaatagtgactaaacattttctagagttatgacattagtgattcatgtagggacaggggttgtagtagctgtcctcctcttagccctcaatcatttctcaaatgctgttttcctgtaactctcaaattactgaaggatgacaccttgccagggcatcaggcacatcagcactaagaatcaagctcactagttttaattccctggctaattttctatggcaaatatgtaatttttctttagaagaaacacattttttgacgcagtcataagtagctttagttgtgccataacaaaggtgtgacattttttctaggcattgaatttatgtggaaatctatttgctacatttgcatcttttttttttctggacagagatgcaagatcaaattgtatcaaatgcacacacattcacatgtaagtatttagatagagtgaagacgtaggtacacagattcagcagtctgaaaagatttactgtgccagggagaaaataattacaacaaatgtttattaagcagcttctatgtgctgtatataggtaggtgtaggggcatgggatgcagtgtaaataaatgttttgcaatctgccctcctgtaaaagttgggagaaaataaacaggtacattcaatagagtaattggggccactttaggggccaaaaggctgcaaaaaagcagcttcctaacagtggctatgcctttcgagggcaaatgtcttcttagttaaaaactgaaacatcagtttgaattagactgttgacaagaagagggaggaatgattcaggaagagggagagtatctctaaatgcttagatgtcagaaagagcatggtcagttgagggcactggaagcggtttagtatgtttggaacagagggtgtgcaagttaactagtgagagctcagggttagtgagctcatgagttggaaggaaaagaagttaaaaggcagcatgctagatagaataagtaggtcagtgagtaacaacatgaaaatcagaggaaacatgaaacaattatgcttctaatttcattgtgatctttgctcttcgttgttaattaaagggatttagattaaaacatgcaattgttatttgaagaactgagagacagtaaattattcaaaatttatccatttaattggccttaataattaatgactagtagctttgtattagatgcctgaagtataaatatatcaactaataatacttgaaaatatttcacttacaatactgaaagtgattttatggactttgtaatagatggtccacacgtgaactaattcactcttaccagagttcttaaatgtgctttcatatttttacatcacaggtggtttttattttatgagtgtagtgatcaaataacttatccaaactgggacatttaaaagagcaacagaggtattatgaataattacacaaagacaatggacataaacatgtactgccctgggtaaaccaaatctatgattcttgttcacagtgtatatcacattttaaagtatgcttaaatgattacaattatataaaatttaggatagtgttttggaatggaacaaactttttcaactgcatgttttaatcttttcatagtctaaagtttgtgaactattccattttgtcttccaagttacacctttacatttttatttgtcagcatgctgaataaatcactgggagaaaaagagaaaaaaatgaacatgagaaatctctaatttgtggcactcaccagctgttaaatacacacatagctttttaaagcagaattcttcttcaaaatgtaggagaagagacttcattttattttttctccgcttttgaaacataaattgggatctagtccaacaaaaacttttagggccaatgaaaaaatgaagtattattaaagtaaaaagagagagagagagaagaaattgaaagatttactatagaggagaactgccagattgtagcatttcaatggtcccctgaacaatgccacaatactcagttattattcaagcaggtggcacattattattacagttagatacctttgcttattatgcccttgacttcacacaaaacatagtaatttgaatctaatattgtctgttaaaacttccattaataaaagaaagtgctattaaaacaaaaaaaaaatctgtggcctattgtaattgattttttttctgtaattgatggactgagttacactgtacccaggtacaccaggacagctgaattcgataataaaggaaaataattgatttttggtttcacatgtgacagtttggaaacagtgctttgtcaaatttcttaattcccatagaaagcagcaccacaagagtcaggtagatccacaatagaaaatcagtacacattgtggagttttatatactctcataataattaacataaaatagtcaatgtaagaaggtgaatctcatgcatggccatttaatacaactggttaaagtggtgttttttgttgaataactcccaaacccttaataaatgaaatcccaggaaactgtagtcatccttcaggctctctccgtggtctgacgctatacctcatttccctgttaactgcttgtagcctgtgcattatgtctccaagcgtttacttctgtgcctccttatgttcaaacatcatttcccacttttattcattgaccatactctttcaatccagcaacatttagcttggggtgatctccagaaaatcttccctgagtttccagattaatttaaatgtccctattctgtgtgtcgttaccgctttttacacgtcttcctcttagcatttgatgcattttatctgatttatttgattatatgactgtttccctttctagactataagttttttcaaggacaaagatcgctgaataaacacaggttctgtgctaaggacatatctattaattgttaaactagacaaccatttctaagtatctgcatatttgtgaagtgaaaagagcatggctttagcgtatataaaactaaatttgaatctcaactctgccccttattagtaatgtaactctaaggtaatcacttaccttatccgaactttagtttccccattttgtgcaaatgagaatattactaaaattgcggcaacagttcaatgaaaaatgcacacaaagcagcttaaacaatgttcattctcagtaagcttccctaccttacttccttttcctttagtatgtttacatttttcaaaaggtaagaaaaataccatcgggatgcatttctagaggttttttttgcatgcttaaatatgagagagttatgtactatatacaaaacttatgctgaatctttgcttttgtcttttcttgtacttacaatgcccttttcccagtcccatctctgcctggcaaattcctgtttttccttcactgcttagattaaatctcaccatctcaatgaagtccatcgaaattaattagaagaatatctgcattttttcagtatctatttaatgattatattaaaatatagatatactattaaaccaaaagtgaaatgccaaatagattagcttagctttgaattatttcaagtctaagatcatctttcaatataaagaaaataatgagacatatattgaaagcatctttggataggcaagacctcttatttttatgttggaaaaatcattaaaaatacattagaatacaattaagtaataaaaatgaaaacaaaattaaaacaacatataaatcaagcacattttagatgtcttaattggtcatgtttttgtggtaaaacgctaattccttttagtagaaaaataatgttagaagacataatgaattgtgtagaattgtatacgcttgaccaaggcatttgttacatataagaatatttagtattttaccccatagtactataaaacgttattttagagaaaagcaatgccatgtattaaaagtgggcttcgcttattttctttttaacaaaaaattgactgactgctgtccacattaattttaattttataacataaaactgcctacagtagcgtctacagatttatctgattagcagttcataaacacaaggaaataagatattagcttaatttaccttaataaccaaatcaaatttctggtgaaagtctctgtttactggctccaggagactaagttctgctgtcctaggatgcatatggaaaaatcgtgggtaatcctcaggagtccctggaagacattgagatttcagtacataattgagaacaataagtaatatgtgtatctgctttttctatttcccttcatcagctgaggaacaaagctacaatttcattagtaaattaagtttcacaattatgcagttcagggaaagcagacacaaatgtggtatatagttattaataattagcatatcagtaagaaaatggaaaatgtttggatgatttttgaaattttttttattaagagggctctaattaatttgaatcttcatcacatgaaaatagacattaagtggagggagagtaaattttttattatgaaattttattttaatggtgcataaatcttaattataactgtttggtctttcaacatatattgtaataaatgattagtaatttgtaccaaatagtgagatgcttggaaattaatgtgaacatattttgttgcatatattatttcttaagattaatatcaagctaataatgttaatcatagtaaattaaatataggttctgatgatactcttaatgtctacacagggtatttatttatgtatttatttttgagatagagccctgctgtgtcacccaggctggagtgcagtggcttgatctctgctgactgaatcctctgccttcccggttcaagtggttcccctgcctcagcccccaaatagctgggattataggcgtgtgccaccatgcctggctattttttgtatttttagtaaagaaagggatttgccatgttggccaggctggtcttgaactcccgacatctggtgatacacccacctcagcttcccaaagtgctagaattacaggtgtgagccaccacgcctagccaagatggtatttcttaatgtattttaataatcaatatacatttcttcatgaagaaatgtcttctaattgtataatcttcctttgtgtactgcaacattcttttcccaaaatgaagaagtcaaatcataaaattgtatagtatatacatttgtaaaattaataaccataagagaaaaataatatagcttcctattatggaaacctactctgtgctaaatgctttatataactaatcatcaataactaaatcatttacattttacagatcatgacttgggagactggggagattaaatgacttatttaagttaaagggacaatctgaaacagagcttttattaaaaatccaggctgccagatgttaaaacacatccaaaaaggggcttattgttactacttattttcctcaactctgagacaagaagggaaattctactgggcagtaaatgagggggaaaaaaaacagaaacatatttcacaccattaaaaccgactgtaaaatctacaaatagtcaaaattatagatgaaatgcaatatatgataaagaagttatccctcctaataggagagtcatacagaaaatcatagagtttcatacattcttcatggaatatacatgagcaaaccccaaatgaagaagatattcataataataaaaaaatgagcactagtcatagatgaaaatgtggataaattttactctaatgtgagagtgagcaaacctttcctaactatggctcaaagtcaagaagtcaggaagaaaaagagataagtttaactatattgcaaaattgcatggtgagacacaatgaacaaagtaaaaccacaagtgacaaactgagaaaacatttgaaatttatgtcgagacggccgggcgcggtggctcacgcctgtaatcccggcactttgggaggccgagacgggcggatcacgaggtcaggagatccagaccatcttgcctgacacagtgaaagcccgcctctactaaaaaaaatacaaaaaattagccagcctggtggcgggcgcctgtagtcccagctacttgggaggctgaggcaggaaaatggcgtgaacccgggaggcggagcttgcagtgagctgagatcgtaccactgcactacagcctgggctacagagtgagactccgtctcagaaaaaaaaaaaaaaaaaaaaaaaagagaaatttatgtccagacaaaatgttcatatcccgaatatatatatataggtttataaattagctaaaaatagggccagtgagggatttaaaaagtgtggggctggctcggcgcagtggctcacgtctgtaatcctagcactttgggaggctgaggtgggcagatcatctgaggttaggagttcgagaccagcctggccaacatggtgaaaacctgtccctactaaaaatacaaaaattagctgggcgtgatggcgcacgcctgtaatcccagctactcgggaggctgagaaaggagaatcacttgaacccgggagacatggaggttgcgtgagctgagattgtgccactgcactccagcctgtgcgacagagccaaactccgtcacaaaacaaaacaaaatgttcggggctagagaaaaaactgttcacagaaagagaaaggcaaatgactctagatcataagcaaagataagcaaagatgcttatctcgatacataagaagaaaactacaaattattcctacattaagatttcattagtcacttagattagcagttgtcccagttggagactgtactctgttggcgagcctgcaggaaaacagacactttggacactggtggtgttaatacaagtgttgtaaaatttatgaaggagagtatgacataagctaccaaaataatattaatgtttactttttgacccatacatcccacatctggacattttcccatttataataacggaagataaatgaccacctaaatatacatcaatagtggtctgggtaaataaatggtgatacatcctaaagcagatgataattcaaatgtaatgataaatgatagatatctttagctattactatggagttattttcagctatattaagtaaaaaaaagcaatttggaaacaagggcctataatatgctaacctttaagaagaatacacatgcatatttacaaaggaatacatacacacatttaaaaatcgaagatagactgtaacataaaaaattgttacttatgagaaagagagggaacacgtggagaggataaacactgaaactaaatttcattacccatatcaagttttttacattttagagctacatatgttatatattattataaaactaattaaattcaaggacttctctaaaaataaaataaaataattcaatctaaatgtatatttagttgttggcacaagcacaaacaaaaagaactaccccaggtgaattttaaaagtagtactgacatcacacccacagtgtaatataggtgaagtaccagagaaattacaaaactcaaaaagttaagctatctacagtaatcatattggtggtatgttgtgattccaagatagttataggagtattttacaataaataagcacattattatgtgtcattctgattctattcttttcagtattgaaagctggattcttggcaggggatgataaagagatagaaattaaaaattaaagaggtaaaatagaacacctatggttttgattttgaattggcagtggaagtttaaactcaggttgtagtttatcttaagaaacaaaatgcatacaacacagctctgaatgctgaaacacagaactatatataatggccaatatagaagcgatgaatatttctaatgttcagactatggttttgaaatactatttaccaataaaagcacttaagatttctgagagagagagctgatttcaggtccagggcagaaaatcaacaaatagctgtgaaacatctgctcacactaagtagcaagaaagaattccgagactactaaactgatttgaaaagttttcaagagccaaaaggcttttttttgtttttttgttttttaagctaaagataagacaatttgagcatcaataaggatcatatcagtaatgatttgaaacagatcaaatatgtttaaattcataagtttacgagtgttgcaaaataacgtattgatcacttttggagcatgctagagaaatattttgtaaattagaaaataagaaaacagagcatgctttttccatatgagcttaacatggggtaaacaaataattgattaaaaagtgtctcattaagaaactatttcagctaataatttaagaagagtaatagtatcagagtgccatcattttacaacccctcataaatgaatggatcatggcattgagcactaaatgctgctaatatcacaaaaaaagagataaagccacatacataccactcaatagaagaattaattcaacatcatctgctatggcctgagttgtccccctcaccattaacaattttatgttgaagcccttactcccaatgtgaccattatagagagatagacccttttaagaaggtaatcagattaaatgagtctatatgggtgggctcttaaatctgatgggactggtgttctctttgtctctctttctttctatctcttccctctctctctgtccaagggcacacagaggaaaggccatgtgaagacacaagaaagcagctggagaagcttcatcaaataccaaccatgaaagcaccttgatctcaggcctccagaactgtgagaaaacacctttctgttgcttaagctactcagtctagggtgtttcttaatggtagtgcaagcagactattataccacctatgaaacagttttgagaaaacccaacaaagaaacaaacaaaatatgttatttgattaagtgtcaaaatttataggaaacatgggacagagtaacatgtaaaattaaaccaaggaaagtacaatcaagatgacgagaaactctataatataaacaacttgacttctcaataaatgaatcacaagaaaacaatttaaaaataaatggaaagagaaccactgtagattaaaagagacttagggctgggcgcagtggctcacgcctgtaatcccagcactttgggaggccgaggcgggaggatcacaaggtcaggagatcgagaccatcctggctaacatggtgaaaccctgtctctactaaaaaaaaaaaaaaaaaacaaaaaaaaaacaaaaaattagccgggcgtggtggtgggcacctgtagtcccagctactggggaggttgaggcaggagaatggcgtgaaccaaggaggctgagcttgcagtgagctgagattgtgccactgcactccagcctgggtgacagagcgagactttgtctcaaaaaaaaaaaaaaaaaaaaggagacttaggagaggctgggcgtggtggctcatgcctgtaatctcagcactctgggaggccgagacgggcagatcaccaggtcaggagatcgagaccatcctggctaacacggtgacaccccatctctactaaaaatacaaaaaaaaattagccaggcttggtggcgggtgactgtagtcccagctactcgggaggctgaggcaggagaatggtgcgaacctgggaggtggagcttgcagtgagccaagatcccgccactgcactccagcttgggtaacagaacaagactccatctcaaaaaaaaaaaaaaaaaaaaaaaagagacttaggagaattatcaatcccaacgtgtgaacttacatgaattctggtccccttgcatctctccctttccgagaaaaacaaaaacaaaaaaacagaaaagaaactaaaaaacaaaaataatatttgtgagaaagtgaaaataaacactgactgatatttaatattaaataaggattgttatactttttatttgtgctatgatattgtcagaatgctctaaaaatagttattttataagcataaattcaaatatttgtggattaaaattatatattttttcaaaataatgaggaaaaaaattgatagacatatatattttaataagtttggccaagtcttcataattcttgaaactaagtgatgccaaatggtgattttatttactatctcttattttatatatttttaaataagagttttcaaaaatgcaatataatttatcatttgctttggtttgcttttaccctagctttcatcagcatagaatggagcagggctcctggaagaatgaacccaaaatggtgaagataattgaataatagccgctgagctgggaaagattttcatttcccagagagtaatacttactagctgttaactagttactacggtgaaaatgttataatctctttatttgtaaatgatctatctcatctaagtttcaaaacaatcttatgggaaagatatttattgcttgatctgtgaagaaaccaacactcacagaagttaagtaaaatattctgaactctcacggctagtaaatgactaggtcagaagtcaaggtatctaaattcagagtgtaaactctttcctgttatgctatatagcctgagttcagtgaattagacactttggcttcatcggccatctgtttctggaaggttggtttttagacatccttacagaatatcaactcaacaagagtataactagcaattaaaaaatacatctccttagcactttgggaggccgagacgggcggatcacgaggtcaggagatcgagaccatcctggctaacacggtgaaaccccgtctctactaaaaatacaaaaaattagccgggcgtggtggcgggcgcctgtagtcctagctactccggaggctgacgcaggagaatggagtgaacccaggaggcggagcttgcagtgagccgagatcgcgccactgcactccagcctgggcgacagagcgagactccgtctcaaaataaataaataaataaataaataaataaataaataaataaataagtaaaataaatacatctccttggacaaagagtaaaaccaagtgaaatttatttccctgcatttcttaaaagtgtaatgcttttccagcgaggactaagaacacttaatgtttgtgctttcattatacacaatgtttacagtcaacctaaagctgttctttagaaacaaaaaattagccgggcgaggttgtgggcacctgtagtcccacctactggggaggttctttagaaacagctttgattgcctaaatttagatgtaaaattgataactatgtttattatcacaattataaataatacggtgaatttcagcattataattattagagccaacataattagtggttgccaaaacatttattttaatttttatatatgctaagaaaattctacgtttttcactttttcagtattatagaggaaatggcaacctaaattaatcccttggtgaaaagtttacaattttgaagattacgggttttctgtaggataaagaaaaaatgctacacaattatcttcatatatttaaaatgtagaattttaattacacgtgttgatcaagatagtatcaccatgactaagatagtaagcctatccataattgccagaaatttccttatgacaatgtctcctttctctccccattcatatttctcaccctatgcaaacactgatcactttctgtctgtcagcataataggaatgggatcatttatatagtatgtattcttttttttttttttaattttgagaaagagttttgctcttttttctagtctggagtgcaatggtgctgtcttggctcactccaacttctgcctcctgagttgaagcaattctcccgcctcaacccccagagtagctgggattacaggtgcccaccaccacgcccagctaatttttgtatttgtagtagagacggggtttcaccatgttggccaggctggtttcgaactcctgccctcaggtgatccactggcctcggcctcccaatgtgctgggattacaggcatgagccaccctgcctggccttacagtatatattcttttcgtaggtgtgtctggcttctttcaattagcataatgattttgaagtccatgttgtttcatttatcaatagtttatttatttctattgcctaggtgttattctattgtatggatatgctacaactcatttatctattcatacattgatgaacacttgagttgcctccagccacaaataaagatgctatgaactttcctgtatacctctctgaatgaatctatgctttcatttatcttgagcaaatatctaggagtggaatggctaggccatatgatatgtctatgtctaaatgttttattaagaatttttgggcagggaacaagtctgttaattttcagttacgtataggtttgtgtagtcaataccacaatcgggatatagaatggttttatgatcaaataactactttgtgttttccttccccaaagttaaatctttagcaatgactgatttgttcatcaccaccgtactttcatctttttgagaatgacatttagatggaattgtgtagtataaagatttggagactggcttctttcaactcagtataaagcattagagattcctccaagttgctgtgtatcaataatattatattttcattgttgagtaatgtttaacttttaaagaaattgccaaattatttttccaatgtgtctgtaccattttacattcttaccagcaatgtatgagcatttcagatcttccacattttcaccaacacttgatattgtcagtcatttaaattttggccattctggtgtgtatgtagtgatattcattgaggtattaatttgcatttcccaattagctaatgacattgagcaacttttcatattcttattttgtttataaatctgtaataatttgttaaaactttctgccattttataattgtctcatttttattaaattgtgttttcatatattccccaaacaagtcacttgttggatacatttcgcaaatacattctccttttctgtcagttctttttcagtctattgtcagtgccttttgaaaagcaaatgcgtttttactttgatgaagtcaaattttaaattttttcttttatagatttgcatttgttacatttaagaaattgttgccagccgggcacagtggctcacgcctgttatcccagcactttcgaaggctgaggtggggggatcacctgaggtcgggagtttgaaaccagcctgaccaacatggagaaaccccgtctctactaaaaatagagaatcagccaggcatggtggcacttgcctgtaatctaggtactcgagaggctgagggaggagaattgcttgaatctgggaggtggaggttgtggtgagccgagattgtgccgttgcactccagcctgggcaacaaaactacgtctcaaaaaaaaaaaaaaaaaaaagagaaattgttgccaaccctaaggtcataaaaatctttaccaatattatcttttagatgctttatagttttagctcttacattatgtatagaaagtctttcaagttggtttctatagatagtgtgaggtacggattgaagtttatttgtttacatatggctgtccaattgttctgcaatgttggttgtaaagattaacttttccttcttttaattgtcttttgcttcatattatttttgaagtgtttataccttaacagttttttctcatagctgtatttgcctatcatttattagcataatacttctgattccctacatatagtaaattgaaggaaatgtggatgcctgacctaaactatataattaccacttaatctttcaataatttttatttagagcaaagaatcagaagatggatgtacaatctgtaccacaaaaataatgggcatctagaggaaaggccctctaatccctcatcttgaaattcctgtttctgcttcttaaaatgttattgtttttgacagttccttgaattctggaagaaaacaaagtcctttcaataaatttccttaaacgccaagatgaacttaagttcacctctgtattttttacccaaagaggcccattcaggaaaacatttgtttttaatgcttcatacatttgaaaatgcacatctaatatacttcaaaggagcactacctcaaaaaatacagtatcaaatttttcccttcaccactgaaaatgtttatctttacatataaaattagtaagctgattaacacagaaataaaagagaacactgtcttctgggtgccatgaagatgtgtggtaattcctcagattttgacattgtagatatatagaaattatagtcagtttcaataaaacactgctaatgaaaacacccacaatttcctttggtagaacaaaaacaattataacatgtaacttatctctccaggtaatttttttgtgaaaaccttttaatgaaccatgaatgctggataccctgcagaagccaaggtattgaaatgtaaaaacattgtacgagaatagaaacacatgtctaagttcaaggtccctacagaatcccttatttatcccacttagaaaatgtaatataaactctatttagcaaagcttaattcatctaaaaatatagctgcttctgaaccatctctgaagctctgggttttatttctttttagtcattcccttatttgatcttgggattaattatattaatattccattcctctgacattaaattcacctgctaccccttttacataactaaaattttgttgataattttaaccattattttcatctatgccctaacaacacatttgtttttgtatcaagttatccctaggttcaaacatatattagaaaaattacctctaatttctcattattttcttccattaattttaactttagcactttttcttttcagctaatatgttctcttagtgcattctttgataattctaaatgcaaaaagtaaactacctttgtcctgcttttacagcttccaaaaatcattagttctaaatctgtctcctttgcaaaacttctttttcagctacttgttataaataacgaacttcattttcttatcgaaaatgtttttaataactgtgtaatagccaccaaaataatttaaatccatttttacatattattagggaaaactaaaattcttatcttagtagccaatatctcaacttcaaaaaatctttaccaaagattttattgggttgcttttcctatgcatatttatgacaatgcttctgattgtatagttcaggtatacctacactagaaagaccgagttcttgtcccagatcttctgaatcagaagctctgaaaagggaggtcaagagaatgcactttgaacaatctcactgaattcttgtatcctttaaagtttgaaaaccacctcttcatggtacatgatacgttcatatctgttatttaaacataaaaataattacaaaattcagaaactatgttattactaatagaaccaacattttttctgactacgtagattcaaatccccaagttactttcactagccagttctctacacattttccaagtgattcttccttaccttagaacgtctctctgatgtgttcctttttcatagtcctaatctcttaccttacttagacccttgtcatttcatacttgtaccacggtgatagcctcctaatatcttctgacattccattcccttataatcactgaaggaaactttctaaaacgctacttttattgcccaattatctagacaaaattttatctattgtgtactggggtaacccctaaaatagaattgagaataaaaggtataaatttatttttctttatgattgattcaatttacatatagtgaaatgcacagatcttaagctttaacgttttaggggcatagacccatgctattaccactcctattcaaactttatatttatttttaaataaaataatacaaaagtaaacttagctaatgctttatatactgactgacactgtgtctctgtatgttttagggacaagcaaggaatcttgagggagatgtgacaagtgtacagtgtgaagggataagcagcagtgtattattcagagttctttagagaaacaaaacaaataggctataaggacatattagtactgacagtgagaaagaaagagagagagagagggattgattctgtcaatcaattggctgattgattatgcaaatttgttgttttagtccattttcacactggtgaaaagacatacccaagactgggcaatttacaaaggaaaaaggtttaattggacttacagttccacgtggctggagcctcacactcatggtggaaggcaaggaaaagcacgtcacttcttacatggatggcagcaggcaaagagagagagagcttctgcaggggaactctgctttttaaaaccatcatatctcgtgagattattcactgtcatgagaacagcaacggaaagacttgccaccattattcagttatctcccacatggtccctcccacaacatgtgggaatttaagatgagatctatggccaggcatggtggctcatgcctataatcccagcactttgggaggctgaggcaggcagatcacctgtgtcaggagttcgagaccagcatgcatagcatagtgagatcccatctctaggtgagatttgggtgagacacagccaaaccatatcattctgcacttgacctctcccaaatctcacatcctcacatttcaaaacaattcatgccttctcaatagtcctccaaagtgttaacccatttcagcattaactcaaaagtccacagtccaaagtctcaccagagacaaggcaagttccttccacctatgcatctgtaaaatcaaaagcaggctagttactttctagatagagtggggatacgggcattggataaatacagccattccaaatgggagaaattggccaaaacgaagggtctacaggcccccaagtccaaaatccagcaggaaagtcaaatcttaaagctctgaaatgatctcctttgactccatgtctcacatccaggtcacactgatgtaagtggtgggcttccacagccttggacaactccacccctgttgctttgcagagtgtagccccctcctggctgctttcatgggctggggtcgggtgtctgtagtttttccagaggtactgtgtaagctgttggtggatctaccattctggggtctgtaaaatggtggccctcttctcacagctccactaggtggtgccccagtagggactcagtgtgggggctctgaccccaagtttccctcctgcactgcactagtggaggttcttcatgagatccctgcccctgaagcaaacttctgccttaacatacaaggcatttccacacatcttctgaaatctaggtggagcttcccaaacctcaattcttgacttctgagcactcacaggctcaatactttgtggaagctgctgaagcttggggcttacaccctctgaagcagggcctgagctctatgttggcccctttcagccacagctggagcagctaggacacagggcaacaagtcccaaggctgcacaagcatggggatcctgggcccagcccacagaaccatcttttctccccaggcctccaggctggtggtgggaggggctgtcatgaagacctctgaaatgtcctggagacgtttttcccattatctacaggattaacatacagctcctcgttacttatgcaaatttctgcagccagcttgaatttctcctcaaaaaatgagattttcttttctatcaaattatcaggctgtaaatattctgaacttttatgctctgtttccctaataaaactgaatgcctttaacagcacccaagtcacctcttgaatgcttttgctacttagaaatttcttccaccagataacctcaatcatctctcaagttcaaagttccacaaatatctaaggcaggggcaaaatgctgccagtctttttgctaaaacataacaagagtcacctttgctccagttaccaacaagttcctcatctctatctgagaccacctcagcctggttttcatcattaatatcattatcagcattttggtcaaagccattcggtaagtctctagagagttccaaactttctcgcatcttcctatcttctacagagccctgcaaactgttccaatctctgcctgttacccagttccaaagtcgtttctgcatttttgggtctcttttcagcaacaccccactcctgttaccaatttactgtattagttcattttcacacagctgataaagacataccagagactgggcaattttcaaaagaaaaaggtttaattggacttacagttccacgtggctgaggaagctttacaatcatggtggaaggcaaggaggagcaacccacatcttacatggatggcagcaggcaaagagagaacacttgtgcaggggaactcctctttttaaaaaaaaatcatcagatcttgtgagacttattcactatcacaataacaacacaggaaagacttggccccattattcaattacctcccaccttgtccctcccacaacacataggaattcaaaatgagatttgggtggtgacacagccaagcgatatcatttgttatgaatgctaagagcatctactctctgcaaattagagaaccagaaaaactggtggtgcattttttatcaggtccagaggcctaagaaccaggggagtcattggtataagtctcagaatctgaaagcctgagaactaagcactgtaatgtttgatggcaggagaagatggacgttccagttcaagaagagagaactcatccttcctctgcctttttgttctattcaggccctcaatggactggatgatacctgcccatattggtaagagcagatcttcttcactcagtcttctgattcaaatattagtctctttttgaaacactctcttagacagacccagaaataatgttttaccagctctttctacatgccttaaatcagtcaagctgtcaaataaaattaagcatcacaagcagccttctctcttgtctgtttgctttcaacacattgcagtgacttttagtttacatttggccagttaaagggatctgtattttataatattaattttacaccaaactaatgctcaaaaaaatgaataaatagctgagaaatatctctgcaaataaacctgagattaaaggtaacactaatgatatgtgtagaagtgaacaccaacagagatggaaaaatcccttcccattcctctgctaaaacagcttaatcagtcatgttattaggtcaaaaccgtggagatccaggcagaccggaaataaagtcagactgacaattttgatgtaattaatacaattatttataatgttgacttatatataatacaattaatcattttctatgtgatatatgaacattgaaaatttaatgactgataaaatacatgtataattcttaaatattagagtgtgtactcaaaaatattttttaattcatgggatgaaggatcataaaagttatgtattcattataaaatgtagctatcattaactaaatgatatggttttggctgtgtccccacccaaatctcatcttgaattgtaactcccacagtttctgaatctcatgggaggaagcttgtgggaggtaattgaatcatgaaggcgggtctttcctgtactcttctcgtgaaagtgaataagtctcacaagatctgatggtattaaaagtgggagtttccttcacaagctctcttttcttatattttgccatgtgagacatgccgttcaccttccgccatgattgtgaggccttcctgaacatgtggaactgtaaatccattaaacctctttcttttgtaaattatgtagtctcaggtatgtctttatcagcagcatgaaaacggaataatatactaacatacacacacaatcttgcctaaagttatttatgtcttaaagttcagagctccactttatgaaccctctcatctccttgaattacttgaattagatcaaagatggaaaacattttttgtttcctaacaagtaaaataatctttttttcccctcaccttaaatctgggcaggaattgtccttgctttgaccagtatatgatagtagattatttctactgattcagttctgggatcaggccttcagaagtttgatagctttcacttttgccttcttaaaaggcaggcatacatgcaattaaatggactattttaaataaattctataaagaacattttctttaaaaaataatttccaaaatgtagaagtacattaaaattagaagaagcattctagagaatggtaaggcatgaggaaaaatacaccttgggggatatatttaaggttatataatgtttgaaaaaaccacatgtgctcagctataagtgttcagttataagaacccagttgtgtagcacaaggatcatgaaacaaaagaaaatataaacaaaaaataagaaaacaaaaaaggaaacagaaaaatatggactctctgataactgtgaaatatgaaatacaaaatgaaatatggtaactgtgaaatatgaaatacacaatagaagaaatgttgggcccatgaacattttcatcccttctcaatgtgatatatgcattgaggaagggacaaaaaatgtgtttttctcttcacatttccaatatgagtatactgtatacttggccatgaaagtgctaatacttgataatacctaccacagttaatgaaggttgataaaaaaatttaaaccaaggtttctggctctagtatctccattcttaatcaatgggtgacaccaacattttagttgccagaatattcataatattattataatcatactttgaaaaattagaaaaaatactgttagcaatattatatttatgttttagtatgtaacatatatctcatctatatgatatttaatacatattacttttcacacattagctgctcatataagagtacttaatactacaagctactgttacaagctaaagtcagcagactttcttatattattagaaataaatacacattgtatgatatcattattaatgacagtgctgcaacagagcttgatagctgttaacatttacattaaaaatggtcagacttgataacacaattagaagcagaaatttcagctacatatatgattaaggggtctacagattatgcttttctttcagagaccttcatggcaggtttctccaccataggccttgagacttaggaggaaagaatggttttgtgggccaggaccacggctccactgccctgtgcaacctcaggacactgcttcctgcatccagccattccagctctagccatggctacatggcccccagatatgcctcaggcctctgcttcagagcatgcaagccatagccttggcagcttccatgtgatgttaaacctgtggacacacagagggcaatggttgaggcttggaagcctccacttacatttcaaaggatgtatggaaatgtctggatgtccaggcagaaatctgctgcaggggtggagccctcatggaacacctctaccagggcagtgtggaagggaaatgtgaggtgggagcccccacacagagttcccactggggcactgcctattggagctgtgagaagaaggcaactattctccagaccccagaatggtagatccactgacagcttgcaatgtgcacctggaaaaggcacaagcaccaaacaccagcccatgaaatcagccaatggggctgtactgtgcaaagccacagaggcagaaatacccaaggccttgggagcccaccccctgcatcagtgtggcctggatatgagacatgaagtcaaaggagattattttggagatttaagatttaatgactgccctcctgggttttggacttccatggggactgtagaccctttgctttggctgatttctccttttttggaatgggtgtattcacccaaagcctgtacccccattgtatcttgtaagttttttcaggctcataggcggaagggacttgccttgtctcagatgagattttggactgtggacttctcagttaattctgaaatcagttaagacttggggaactgttgagaaaggatgattgtattttgcaatgtgagaatgacatgagatttcagaggaaccaggggtttcatgatatggtttggatttgtttccccacccaaatctcatgttaaattgtaatctccaatgtaggaggagggacctggtaggaggtcattgaataatggggggaaatttcccccttgctgttctggtgacagtggtgtcagtgagtgagttctcatgagatctggttgtttaaaagtgtgtagtaccaccccttctctctcctgctctggccacgtaagatgcgccaacttccccttcagccatgattgaaagtttcctgaggcttctccagccatgcttcttgtacagcctgtagaactgtgagccacttaaacctatttttatttataaatcacccagtaacaggtagttatttatagcagtgcaagaacagactaacacagaagaggtattaaatattctctaatggtagaatttaccagtaaagcatctgatccagaattcttctttgtgggaagatctttttgattactaagtcagtctattaacttgttaaaagtctaccccaattttttattttttctgaagtcagtttgaatagtttgattccaggaatttgtccattgcatccatttgtctagttggcataaattgtatataatattccctcataacatttttttatttctctaagctaaatagaaggtcctctctttcattccaagttagtaaattgcatcttatctcttttattcctggtcagtctagctagaggtttgttaattttgttgatgatttcaaagaattgattttggcttcatttattatctctactgatttcctaatccctcttttattactttccactgtagtctctattatttctattgtgttgtttagctttctttctttttttttttttttttttttaaagagagtcacctccaatctcctccatcactcaggctggagtaaaatgatgtgatcgtagctcactgcagccctgcagccttgacttcccagacccaggtgattctcccaccttagcctcctgagtagctgaggccacaggtgcacaccactatgcccagctaattcttgtattttttgtagagacagggtttcgccatattgcccaggctggtctcaaactccaggtctcaagcaatccaactgtctcggcctcccaaaatgttggaattacatgtgtgagtcaccacagatggcctcccttctgctctttttctttagtttgcttaacatttccagtgtctttgtgacaaatattacattattgattagagattaaaatacatgttacaaagtattgttatttttatttgtctcaaagtatttttctgattttatttcttccatgagtcattgattaaagaatgtttaacttccatacacttgtgaatttccaaaatttccttcattataatttctaattgcattccatttttgtcagagaatagagtttgtattatttcaatcatcttcaatttaacgatattggttttatggcctaacatgatctatactgaagaacattctaggtgcacttgagaagaatgtgtattctgctgttagggggtagagtgttttgtagatatcttttaggtctagctgctttatggagttgttccatcttgaccttaagttactgcatttgcagagtttcaaggttagtcagagatgagagcttagggccttcccaagtgcttcctgagtatatatacagcttgcttttatctttttagaatcccagaaatatgttaaactttttaaaactccctatgaacatcattatctagcttttcctttaaagacttttggctagtcaataattctgccattgatgttcatgacagtagaaccattgaagaggttgacaacagcccttggatgacctcgtcatagacatcagcatccgtatcctcacatatagtaaacagagactgtctataacaaatggaagcaggagaggagtcgtccatgtggtaatttactgttagcttggagaaacacatatattcagaagtatttgtatggatttagggaaaattaagagttttgacaaagtacgtgaagtcagagtcatggatatccccttctgtgtgtgtgtgtgtgtgtgtgtgtgtgtgtgtgtgtgtgtgtgctgtgtctggtttttgtttttgtgtttccatttgtaccagactgatgtgacttaggtaacatgccttattttccttcctaatgctaataacaatgtcaactaaaatgtattgagcattaactttttttccaggcagcattatgtacatttacaatgtattggatcaaattctcacaacccttttgtacaaagatctatttttgttaatcctatattaaagaagaataatctggtcaggtagtggctcacgcctgtaatcccagaacttagggaggctaaggtgggaggatcgcttgaacccaggaagtcgaagcttcaatgagctatgattgtgccgctgcactccagtgcgggtgacagagcaagacactgtctcaaaagaagaaaataagaaggactaatttcaggtaaaggggggctaaataacttaaataaaattatgtctagtgtgagttaaagtcaggatttttaacatggacagtacaatttccagaggctacactctcaacccctacaattctcttccttctaaaaatgtaaatagtgtaaaaggatattattcatttaccttagctgtgacagcaaataattgtaagagtttatatctattgtttgggacaatccactatcctacggttgtaggctgatgaaactttccatcactgtgtcacttttctgttaaaattttttaattggctcctcatttcactcagagaaaaatacaaagtagataaataacatacaaggctctctagtttctgctctgttcttatctgtcacctttctacttttacctcactcacttctttccagtacttccggcccccttgttgtttctgaaacccacctggcaagcttcagttttgatctctgcctagaactcttcccggagatatcaacgagaataacttcctcagcttctgtaagcctttgctaacagcttaccttttgatgacacaagtgctgatgatactgcttaacactgcaacttctactacaatcctcctctgcttttccaatcccattcatatgatcgatttttcccatagcattcacaactttctaactttgataataaacacttacttattatagtaaatgtttattgcctatctcttctgccagaaaactggctccacaaagtcagtgataggggttgcttcacagggtaggtgatcgtttgttgagaaaaagaatgcacataacttttaaaagtgaaataaacttgaacaccaatgcatccaactggctctgagtatcataattatccaagtctgttattaaatttcatcctttggcttttgcacatgctgcattatctatatagataattgtctctctttttccacctggaaactcctgtctttctgctaaaatgacacttcctaagcaattctcataaaatgcttaatgctctcctctcatgagcctacatgtggttcaaactttatttagagtgccttaaatattgtattttaatttatcttttacgttgttttaatgttttttagccacagactccacgactccctaacctagaacattcatctctcatatttgtgtttttagcatctaataagagtgattgacatacagtcaagccttcagttaatgaaataaatgatgctttattatctacaccaagatctctatagacttaaaatagtttctgtttatgaaagttttttacaaatataaaagtctgagctctgcttatgatatttgtgtctttataaagaccaaaggcttgaaacagaattgcttgaattttctttacagacagcatttctaagaaggatacagtatgatatttgcaaatctaatatctgttggttgttgtgtatttgtatatgcacataggcttcaagtaagaggacagaaaggggttgagggctaatgctgaactccattaaagttatttttcaagcacacttcaaaagaagccctttctcccttaaaagatatatagcctgtctcacatgcatctgtctgtctagaggctatgcaaatcagcaacatccatatttcagcaaaagcaatctaagaagagcagcataatcaatttctcatcatttttgcttttgacacaattagtagtatatgcatagggatggattaggatggtttctgtggaatttttcaagaaaaatatttaccaaaggttaatatttcgtgttcccttgggctaatcgtgctctctcaccttttttttttaaatggctccaaaatagctctttttaaattcagtcatatattatcacaattatgtatagtaaccaaccaaaggtaaaacacgtgtaaaatgtttttcattttatattaaagctgaaagttggtgctagaggaagttttatatgataagttgatatgtagaaaaatactaatatgtaggttaatttcctaatattttgaattgctttgcttcttccataaaagttattcatttatcattctacacatttcagtccaacaaattgaggaagcaaatatcttgaattattatttttaaaatgtgtttatacacaaaagtaacaatcatgtcaaataataaactttgttatttaaaatatttccttggaattgagagaatttgttactgtaagattctagaataactgatagtgtaaaatgttatcagatacaaaccaacaaggatggaatagaggattcctggcctatctgatggcggttgaatattccggtcctgatcaatggcttggattggtggcgtaacaataatggggttcagttcttcctgaaaaaaaaattaagagagtttcattcagccgcattactaatacttcatgaaggattgagacagatgctttagtttggaaatctatataacgtctgagacagtaaactcaagtttcaacatttatgatctaataccttttactagttaattttgaatgttaagggggagcaaagtattctcaaagtcaaaatggtaagacatagtgattatgcacatagacatttatatcagtaactactcctaaaaggaaatcaaggaagaatgataatgcacttttaatcttctctagaggatttcacaaaagaaatagcagcctatcaaatagtttatgaagtaatgttttctctttgctttagacaagatttgtaagaatacttgtattctttccttgctaaatcattttttagtttcatacacatcaattatattaaaatataaataaagtaaataatttcataaaaataaaagtcacattattgcaaatttcatataattaaaattgattttaaatattgcaggtatttacatgtattttacaatggtctataagaaataatgtttaaaattataatatacttctttaatttggtgtttcccaatttaatgtccagtactattttgttgtgctatcaggactggcaaacatttttctgtaaagaaccagataataactatctttaggctttgccaaccatatggtctatgttgcagctaccctcaactctgtcattacagcaccaaagcccaagtgggcatggctctgttgcaataaaacattacaaaaacaggtggtaagttatatgaggttactgactactgtgatcataatagatatgctaaaaatacaacaataggtatgttgaaaaataataaaaagcttatctacacagatatgcttgggaaatatgatattaaatacagttttgaaagccaattaactgtactgcaaatcttttcagacttaattatgctaatctgcatactgactttctaagaaaagggtactatttgctcactttcaagaaacacccattaacctgtttttgaaatgatgcctttagaacacagtttgggaaacactactctaagttatgtagccctcatcccaaatatgtaagtggtaattctaaatgaaatacttctaaagggtaattctaaagggaaattccattacatatttgggctgagggctgtgaaacttaaactactgtttcccaaacatttagtatgtctcaatatctacaaccttacattctaaaaaattactgcaatgttctcatattatttcttctcaaatgacagaacattgaaatatgtaatgtacttttatacaaaaccagtagtttcagttctcagcaaaaatgtatagtgatggcatgctaaaaaaagagcaatgatattaaaacattatgtataatacttgattttatattgaagttataataaggataattattgaccaataatttaaacaccatagacattgtatggggtttctctcgagttcattatcactaataggtcctaagtagtctaaatgttatcagtattttcctgaaaataaagagttgttggtagtagcaacttactaatactctattctctcctttaaacgtggaatcagaaccacgaaaataccaaataaatatcaaaattactccattaaatccagaagattattgttcttaaaacgcaactctcactgaacttttcctcccatgctgcctctctctctctctctctcacacacacacacacacacacacacacacacacacactttcccaataatcaatttgcttggtatgcaatacctgtatttctccctaaactgaaaaaaaaatctgaagttctttgaaatatgtatgtttgagcacaggacttaagagttgacaagctctttctagtaatttcactgaggaatctgattgccatcagccaaagtcagcttatacttaagctgtatcactcctggttcatataattaaatctgcagtaatttttccaaaaccgaggctctatttggatcctgtaaaggcatttcaaatctgaggattttctgcagttccattctgcatctcatagtcagaaaaatattttcctaaacaatttttgctattataaaataagtaatttcttatctagaaattaaaataaaattgaatcttagcttttcgtttggaatgtaaaatgtaagcaaatcacaatatttgaggatatgttggctgatcaccttcatctatttatttctatagatttgctaagttacctacacataagcagttttagctttaattagtaatgtagtataaaatattctttctataatatatagaattgttgaaatgagcaacataatttatttacattgaattgttgtataagcaatgtaaaaactaaaagtaacacatcaaacaaaaccaagaggaagggagaaatgaaaattaaattcctcatcttacacatttgcctgtgattaaatatatatatatatatatagagtaagaactgaagaactaaaaagaaacaagtgtagtatttagaattatattaataattagaagatgaaaaactgtgagtatctcaggatactgagcatggaagtgagggtagatgggatagaaaatattttacataaagccatttggtactgtgtgactatgtcattaccatagcccgtactatttgttttaacattattaataaataaattatagtattgagaataaaagaaaataaactctcttgataaaggctttcacaagtttctgcaaatttaaaagaaatggtgtggtttaaataacttatcagaattgacattttatcttgtcctatagagactagcaacttattttacaatatttatttttccttctgctaccataaatgaaattgtcagataatctaggattaaaggtgaaaagaatgatttcttaactattatgtgtatgattacctctcaagtaaactgtgctccatgaagcttgaaatgtttaaatattattaatacatgacattaaagaatactaaaaattatgatttttaggatgaccttgttaaatatttaacatattttataaagatatgtagcattgaagtcagaggcagacaatttatatacattaattagaagaaacaacataaataacatgcattatgtttgaacttctgtctgccaacacaacctccacagtagatgaaaccaggcctggaaagggtattcatataagcaagaacaacccagattgaaatggttccttagaataagtgagaattttacagagagaacagaagtaaaataataataataatatgtacgtattcagttcaagtatttttttttaacaacagggtaaatccaaagaaaactgagtaaaaataaaatgaaaaaggaaaaaaaaaagtagtatatagtagtaaagtatccaatgctgatgaacaaaggaaacagataaaagaaatagtctttgattaccaagtgccagcatattactgtccttgaatttattgaaaaatagtatccttataatgaacctctttttccctaagttagtttcaggtcagttctctgactttaaacctagagtaccaatctaataaagggctaaagataagagaataacagatggtgtgttggctctcttagagacatttacttaaacttctaaattctgttatttattttcttttgctttttttttttttttttttttttgagacagagtatcgctctgttgcccaggctggagtgcagtggcgcgatcccggctcactgcaagctccgcctcccgggttcacgccattctcctgcctcagcctcccgagtagctgggactacaggcgcccgccaccacgcccggctaatattttgtatttttaggagagacggggtttcaccgtgttggccaggatggtctggatctcttgacctcgtgattcacccgccttggcctcccaaagtgctgggattacaggagtgagccaccgcgcctggccaattctgttattttcattgaacacagttacagctctatgaagagaacagaattattcttgcccatgaattgaaataatgtaatcatttacaggatttagcaaatagcagatatttaacataattttgccaacttattctgttgagttatccaaagagatcactactctctggtcaactttgtaatatccactagcagaaaatagtccatctgtggctactgccaggtcttccacagttccaaaaaggagattgattcagtgacttgtttcttctgaagaacagagtctcttcacatagacaataattgctgttgcttattctctgtcgtcctcatttctcctagtttttgactttactgcctatattacagaggaagtacggtatgtgttgaagaaattagaagtccacccatagctcaaatatgcttgggtatcctttatggaaagtatcaaaatgttcctctattttattacaattgctatatttatctttttgccaaaagctttattggtctgtgggcagaaattatcttatttgtacttacaaccctcagcctagtgcctcacagatttcaacaaatttttgttatcaagtcaagaaacacagaaagagctccccaaaccctggatggttcttttatactttgcctctgaagcaaagctgctttctttgctgtctcatttgtcttcaagaagaggtcatgtctcctgaattctgttccagttgataagcatatattagaagcacacaggatagcagatttgcatttcattgctgtttgaactgtcagagctacattccctgtcttagtcatggggacacataagtaaagtgaattaggtccatataaagagattcataatgagaaggtaatcatagaaacgattaaacaataacaaaaaaagtcttctgtgaaaatactgtgtaattatatggtttaagaaccttaaaattattattttaattttaagaaccttaaaattattctattttgaatacatgcttcctattcattagcttttctggagacacaccttctcttttgagcaatgttaagacaatgttttcatgcagaactgttgtattattctgagaggataacagtagccaattaacatttgatgtgagtgagggttaattatgcctcatgaaacctcactaccagattgaaaatgaacttttggtctgaattctatttttatatatatatatatatatatatatatatatatatatatatatatatatatatatatacacacacacacatacatacatacacataatcattaataaaaatatattagcaagcaatcccaaaagattaagaagcctttttgtagatttaataaaatctcagctttctggtcatttaggtgttcatatggttatcttgaacaaaaggtatattcaagagaaacactcagatttcagagattggatacattcactgtttagcttatatcaggttaacagaagtcatgatccatagaacaataagatttaacctattatatcatccctaatgttaaatgcatacatgatgcctatgattttcactgtttcatgcatgggtaggttgtctttaaaataatatgaaaccagttcttacttttaaaatacttctcacttcaccaatgaaaaataatatctatcatttacacaagttgatgggtcagtaaacttaaaaaaatgacatttcgcagactgattattaaagcttccagccttggttgagatagacataatagaagcattgttaaaatactaaatattctcaacttggcatttgaatgatgtcttcatctgagtaacgtatacatagtagtatactgaatgtgcccaagtatttcaaattaactgaaggcattataattatcttcaagaaagaatatgttctgatacatccctggaaaggtaatctgagctcatataagtacacagtttgctgttataaaagccaaactttgatgtattatataatattccacttatcattgcttagatctttacactgtattttaatcaagtaataacatcatagtatttggagaaaggttatgctaaaatagtaaaaatatgctgtaagtattccaagaccaataattaagtgatttgaaatcttagtaactatataatttaatacctaagttattgaatttattatttagtacttaattactttcactaattttgtgtgttctttacatttaagtaggtgctttttcaatatctattaaagtcattaatatttaatttgtacacttcctttaacaacagaaaatttctactacatttaaggaaagtcagtgtcacgcctgtaatcccagcactttgggaggccaaggcgggcagatcacgaggtcagggatcgagatcatcctggctaacacggtgaaaccccttctgtactaaaaatacaaaaattagtggggcatggtggcgggcgcctgtagtcacagctactagggaggcataggcaggagaatggcgtgaacctgggaggcggagcttgcagtgagcagagtttgtgccactgcactccagtctgggcgacagagcaagactcagcgtcaaaaaaaaaagttagtgaacattattagtctcatttcatattacattgcaaatgtactattttcctcaaagctcttgattattttcagccagattcttgcttgtttccatgtgttactaacatagagaattagaacaaatcaaaaattttctcaaacacattcatatagacataaatacaattatatgttacctttagaggccaaacaaccatttctgttttcactttgcttagttttgcttttttcaagggtcagaaatatcagattgtttgaaaaagtatcagacatatcgaaatgtttttcctggtgagattattttaaaaaatagtaacgaattggggtgagtagtatgggccaagccaattactttgaactttttgtattgttatggaagaaacacaggttgaacattcacaaacctctttgaaactgattcactgcatatatcaaagttcctcaaatggttttgacaattattatccttagaacagaagagtgaagagcacatttgagataggtatataattatgattcatgaaaatcataacaattcatgcctgatcactggaatttcgtatcacatattaaaacaaaaactcacttagctaacagaaaatacccttgttttattatttccatgagcaaattttatgacccctccaatatcatactctttattctaccaagtatgtgtaaatttaccttgtataatgtgactgaatttgtttccaaaatgtgcatttcagtatcctctcaattgcatatttgaatacttttactgatacttcccttattttcaaaatacttccttgaatgtctttgtctttaaagtttgtttacctgggattatatgcctccttttctatggatcatcaaatgatttctagacaggcaataaaaaccttggctggtggtaacccggtaattattttccatgaataaataataaaagcctgtaacaaaatcttgttggtaacaaaaggttggtgacttgttccacgctgtccaagtgacaaagtctgaagcattactgcaatcaagttggctttgactatcaaaaatcgttttccacataactcaaacctgagaatatgcatttcacagatgttgtaaggaggatacatagatcacagaaatatttcttacaaccctttctcacattcttatccatttctataacaactattctggttcctacttctcacactgccacagggctaactcaaaatcttctggttattcacctccccttcattcccatcgtgcacatcaaaaatcctccaaacgattttgacaagcatgacccactctggaagtcagaggaaaggaagaaattgagcagacagagtttgctttaccatgaagataaggagacaatcttgggagaatttatttgttcataattttagtctcattaaatttggatgaatatttcaatgataataatgatatggttcccattgtgtgctctcatcaggtcaggagacgactgtttttgtgatgacttcaattcattgtcaaatcacaattctatctaggacctccttgttagcagggactgtgtgagcactccctaggtttttcaccctcaatctctccatataaggcctccacactcaataggaaggcaataaaacaaggacaacaaatatgaaacatatataacaaagtaggccttttttattgatttgattttggagaaataaaatctgattttgcattatcagatgcagtagtttggtaaaagaacatacatttttaatttagataaatgaagcaaagtaatgtacagttttcccaagtggttttatcattttatatttctaccgagtatatgtgtaataaatgtgaaagttcaaatcaatgggagaaaatggatttttaataaagaatgattaaatattggttatcaataaatagagaaaaaaattatgatagatattgactttaccaaataaagctttggaagattgccagataagtctttaccagatacatctttggtcgattgcttatgccaaataaatttttgtagaacaaaagtgaatgtatgagaaaaacacatgtattagaagtcaacatagtagaaaataaggtaaatgattacttaaaaatattgcaaatgcttgcttagcaatgatttaaaacaatcccaaaaattggaactgttgaaggcatgaggagatgtgggcttttatatctgtgatggaaataaaaagcaggttaagttcaaggaaaaaaaaaatgaaatctatcactaggtttgacaatatgtatagtatagattaaagcatttcaatttgagctttatcttacataaatattgagagatatgctcggagatgtgttgagaaggatattcattgtacaatatacaatttgctttttaaaagaataaatttcttattcaagtacaacctatgagataccttcataaatcaatagttcacagtctgatgaattatcacaatgttataattataaattccaggaaaaaaattgatattttcacaaggtctgacaatatatgtagcttaaacttcaggattgcactttgagcttcatcttacataaatattgagagggacatacgctcagagatgtgttgacaagaatattcactgcacaatatataatgtacttttaaaaataaatttcttattcaaatataagttatgagataccttcctaaatcattagatcacagtctgacaaattattacaaagttataattcattcatgtaatcacactgtgatcaagaaatagaatattgtcagtatctcagaaaaccacttattaaattatctactcataactacccctacttccatcctagagatggcctgatttgtaatatgaaagatttgttttacctgttttaaattttctataaattgaattacatagtataaaaccttttatatatggctttttaatcaattattatgtcttatatgatatgtatgagtgtaagattcttgcatataattaagtgcagtactagtatactcatattaatggttatactatcatccattagatgaatacatcatattttatatgttagttttttttcaactggcgatgaactttgtacttcttctagggtatgctgtgaggataatgctcttacgaacactcttgagtatgtcttcttactgatatgattgcatttgtgttaaatagaagaataaagttgcagagtatgtatacattctgataggctagattactgtcagttttctaacgtggttgtatggtttacattctatcacagagtaggagaattctaactctttcacatctttaccaatttcagtctcttaagattttagcaaagccagtgaatatgtattattatcttatagttgctttaacttgaattttgatgatgattaatggggttgaacaactgtttgatgatcttggacatttgtaaagtgctgttccatatctcttgcctattttagttgaattgtctgttttccttaatgattcacaagagttcttcatatattataattaagtcatttatcagcttaatgttttataaatattacaattcttatggcttatatttagaccctattagtgttatcttgtcaaagaaaagtttctaattttaatatagttttatttatccctttctctttccatatatacctggctatttcctctacctgtacacatatcctgaatgtatgaagtatagacaataattttccttatctatttccatagataaaatattgcactcatccacatcagaatttatgtaaactgagttggcttccctacaactttcttgagagcaaagtgaaggtctattttcttttatatctgtaggaccagacagtacatatggcacacggagactcaaaaactttgaataaagtgtttctttgttgtagattatttagagtatttttaggctcatacacacttgccttgctctctgaatttctgtaggacatctaaatacaaataatgatgttttttgagaatctatttataatttcaatatctttgagcttcctaaattgctgcatttaactacaggccaaaataatctggtcataagagtgaatcatatacacatataggggctcacagcgcttcattgagatggccttttggggtagtacaataaacaatgtcataaacattccaatagaatgaacggtgaactcctatgtcctacaacaaaatatgccaagcttgccaataagtagcaataaagcttttcgataaactagtctcttagagcttgaattatgattttcaaggtgagattaataatatctacattacttgcaccactgcactccagcctgggtgacagagcaagactctttctcaaaaaaaaaaagaaatatgtatatatatatatctacattgcatgattgatgtgaggatgcatgaaagaatatatatatatatatatatatatacacatacagtaaatgacattcttaatatgtggaaattattatagttagttttttaaattgataattttaatgcttttaaattgtgtaatctgggtgttaaaattgactccaagttataagctagggagaaaaaaattttcatttgaaactagaagcttaattgataccatgtcttacacatctgtctgaaaataggacagtgatatgaattttgaaagtttatttagaattccatagttgatcaaataattgaggaagtaaaaagggattatctatctctgctatttaacttgaagccaagcttcaaatgagaaacttatgaattaaattatttaaaaatcgtacttaaaaataagatagtctgccagagagttgaatattcacttaaaatagttatcttattttgatttatttaaaggtaacttcagtgaaattattttctatagactaagacatatcatacttttatatccaataataaattcattccctacatttttattgtaaagagttgaagtgaaatttcttaatttgttaacattcagatgaattatataaatgcattaagcagttggcaggtaccaagaactctactaactgctcaagcagtagaaaataaattagacacaaattctggagatatgaaaaagctcacagtatcagggatggggattcaaagtgcaggtaccacaagttaatttagaaaatgttttgttagggcatttctcaatacatggtaagagaaagctctgataaaaaaattcatgctgtcaagtattaaaggtgaattataaaaaataacaacaaacagacattcaagcatgtgtactttgatccaagtatcaaatgtgatactgctagtgaaaaatgatgttcttgtctctgataggagtgggaaaaaagagtaacaaaatatagtagaaaatcatctagagacattttgaggagagtttctaaatcgccttaaaaatggaggagtttaattttcataaactgagttgccaatgaaaaacttctataggtaaatagcaaaaatatttattgtcttggtgattaaaaaatgatcctagagtatctttaaaagtatagttcagagaagcaaaaatatttataaccctaccacccaatgattatcatttttaatatttaaggtattttgtatcagtatttgttatctatgtatatatattgcttgtctaattgtccgtatataaacacatgtaatattttaccatgttccatatttaattttgttgacattttcatctcatatcataacattggtcttcatcaataaatatgcatcaaaaacctatttttgcaatagctttccaaacccactaatgtcataatttataaaatgatatatttcctcttcagtagtgtgtaaaaaagtctaactgcagatgcttgtcaatagtgagggagatatacatctagagtgttgctagttaagcataaagtataattttaaatttctttggtcactagcataatttacttgatatatttgtgtcttgcctgttcatttactttgcctattttgctttgttttaatttgggcattttaaaattttatttccatggcatatgtgaatagcatagaaatcaacactttgtcaccagccttaaacatattttcagtttgttgtttgccttttagtgttgtttttgacatttaggaggttggtgtttttatttactcaaatatttccctttccttttggatttcaggctagatactttaaaccatctgaaaattatgtgaatatcaaattatctattttttttcaagtactatggcttttttatatgtaatgtttcaatccatcaagaaattgaatagtaaagacttaatactcaccaaattataggtggaattttaatctttatcatttataacagaaataaaactagattgaaaaactatattttcccattgtatcttaaatggatatcttatttatttatttatttgagacagagtctggctcagttacccaggcttgagtatgatggtgcagtctcacaacctccacctcatgggctcggaccatcctcccacttcagcaccagagtagtagctgggactacaggtgcatgccaccacatccggctttttttttttttgtattattggtttcaccattttgcccaggctggtctcgaacttctgagctcaagcaaaaggcccacctcagcctcccaaagtgctgggattacaggcatgagtgactgcacctggcctataaaatgtaatctcattgcaaaactcaatgatgccatgcttctataatatgctattacttttttttttttttttttttttttggagacagagtctcgctctgtcaaccagttgcccaggctagagggcagtggcgcaatctcggctcactgcaagctctgcctcccgggttcacgccattctcctgcttcagcctgtggagtagctgggactacaggcacccgccaccacgcccggctaattttttcgtatttttagtagagacagggtttcatcactttagccaggatggtctcgatctcctgacctcatgatccacttgcctcggcctctcaaagtgctgggattacaggcctgagccaccgcgcccggcttattacattttttaacacaggttttctctagtagaagagagccatgatatttaggattatggatatgtgtgaaagctagacatttaaaaagcacacaatgacttgaaatatggaattgggtatcaaataatctggatttacggaaaactagtcacaaaattcatggagataaacaagatggaatgccaaacaagaaaagaccatgtaattgcatttgttaaatgtctctaatgtgttccacatccacttcccaatctctctctcacacacacacaacccaacaaaactgctttccttgtaaataaaatttgagggttgaaaaccaacatgtatactttttgcattacacatgtactttaattatcattttaaattcctatattaagttaaaaatacatatttagattaattttattggtttaattctttttcttcaacagtcaattgacagacgtctttgagtacttttattctgaagataatatgaatccttgtatatatgagaatgatgtttcattcttaaataaaaatttgattgaattttaggttctctatttacaaactttttctttcaatgcactgcaagttctacctaatctttgctttctttatgctttcttctttaaccatctggtagaaatttgcttttatcctagaaataaatatagtttaccagggattttccaagtatttgtctgtgctttaactgtgattcataattaacacttttgatctgcaaacacaggttctttatataacccttgagtgtttttgtctttgtttttgtttttccttacagtatctttgttattgtacttgcttacttctcctggtttattaataaacacaaactaattacatttttatctggctctctgatcttcgttgctttattctcctagtcagttcgtctgtagtctggaagatttttcaaacatgtaagagcatactataaaatcgtagagagtgctttttttaaccaggctgatgcagacaaagtcttgcctctcaaattagtttctgtgaactccaccttttgctggtctataaaataaagagtaatcttaccttctttaccaagaggtttgtttattaactgtggaaatgcttgtaaaacacctactaccattgtcctatcaagttctaaaaaaatatttgttattattgtttagagtcgcagctttgctttctgcatcttaaatcctatctttctgtcttaaatctcttcagtttaattatttcatttttcttctgtatcaatatctttatttaactttcaatatcatcctatatattccattcttaattaaattttatttcttatccaaacttttaaaaataatttaatagtgtttcttttagtcaatcttattaaatatatgctcccccctgcctttttatcttcagtgtaaaatgctgctctaatgttgtggaatctttcaagggattcaagtgtgtttgaaactgtgtattaagcgatgatcactaccttgctgactgcaaagtttccatatttctgtggtggagaggtagaaatctctcctttatccctgtctacatctcttttccctctactgctgctttcttacactagtcttggcaaaaatcgtacttagaccccttgtttctagtgttgatgcaacttgtcatccctttttgctgtctccacaagtacatcaatagggccatgagtaaaactaatgcagatactagtagctgcctgacatttcaattcagacctactctatgtatttcaatccaaacctactttaggttaagagatggaaaatgacatcacagaagaggtgttagttaaaactatgttttcaaagattgatacttcgaggcaaagccttctcctctaacttttccagatagaataatattgattatcctcactattcccattaaaatatgctttcctctgcattagattattaatcagaactctcacattcttagttcatcatcatatattttatagcagtccagtccagaggaaagcatgctgccatcagagccagaacgaccaaggtcttcaaaactcttctccacaacttattcattatgtaaatatatctttctaaatatcaacgttgtaagtgtataatagtaacattaatttacaacgattcatatatcagattagaccaattaatcctatgtcattttaattatagaacttttctcaggatttttttttttaaagtaacattagacggccttgcagtgactgtcccagggaacattcaataaatattagttttataatttcttattattctatttatgtataaatttctttctgatctgtactatagttatattgaagagaatgtctatttctttcatgttagtgccttacttggtgcctgacacattgtagatactcgattgccacttattgaatcaaagaaccaaggtattgattgaattatgggagtaaaataattacaacatgttataaagctgggagataggaaaatccaaaagaagagatacattttggggaaaacaattacctagtaaattcgattgaggattgggtttactagagaaatatcattttaaattcacaattcagaactggagaaaatttaaaagagtaagaaacagaaaaaatgaataaaaataactttgttttgatattaattttcatatgttgattgaaccttcaatataggcgagaatattaaagttactgcattttcctacagtttttttgggtatattctatatggaatgaacacagtggtttttattgtcagaatattcaaatattactactaatagcactatctgtcactgatcacattcactagcacactgtagaccctacatgtacatcgagaatattgagaaatctgtgacaacagtgagttatatattttattgacttcctctagttctgtatcatccagcatagaggacacataatactttacaaaatatacccttgctgtatgaagtaccaacatttttagtttcatttacagaacaaattctgaactttgtctctgatataaattatgttatacagcagcatttaaaagagatattagtgattagtgatttctttttataaatgcaatgtgaactttagtaatattaaaataattttgtcaccttactatatttatattaaaatatgcatatggtaatgcttgctataaattaaatcatataaataactgttccttttacagctggtttgaaaacattcttttgctgtcttttaacgtagattttagatctcaaatactgtatttttaatttaatagaacacatggccatttaatactaggaagaaaaagagatgttaatgtcattttccaatagtatttaatctaatatgttaaaaattttaaacatatacagcatttgtgcattagctttaggaaaaatacactagcagtaattatattctttgcagaaacatttctgaaattaacaaaatgaggaatataagtaaaccatttttaggcattgaaaaggataaatttatcctaaaagatgttgatttcagactcaaaataccataaactctatctgtttcttggtatttaaaattgaataaagaataataacatcctcttattaccaagaggacctactgtctcaccccgtggttagtgtatgtgacttaagaagcaatgattagaatttgtagagatgatgcaagtctcacattgacaaaaagaaaatttagaaaacagcaatgctaaaaatagaaatgcacaccaggatatactagcaacataaagttttaatgctttacagagctcatataacctgaattttctgagaatacaagaggagcgaaaataaaggttcatttttttgatagatagtcttggtgggattatgtctgcctcactgaacagtataaaacatttggcagagcatgtataataaccaccaatagcatggttcccaattcactcttactcaactcccacagctagcatctgaatcacaaacagaatagaagcttcccagaactcaaccactggcaacatttaaatccctcagcatactgaaggaccttgggagattagggtctttttgtggaagggcaaactgaaacacttggttttaatgtttgaaattatcatgacctaaatttgttttcacacttctgttttgtccttgtagtagaggtgactactttaaccacagcagggtactgttgataactctggatgctgatgcctgtaaggcactgatagatgcttcataaatctttttcaaatgacattcttgatatttgcccaccgggtctctggaagcatctgctaaacttctcaatttgtcttcagaatttcaacgtaattttttttctttctcctttctgcattggcaacaatttatgtcttccacataggatgtacttctttcacactatgtggatatttttaaaagtgtaggtaccatcacactcgcatcagaagcatctgttaaagtaatcacactggtgggggtgaccccagaaagcacatattctcataacaccttacaagagctgtaggtaatttgtattttggacaaacatgtcagactttttttatgtacaaaaaagatgtatacaaactataaccttttaaccctttctgataagccttcctatatcctgacatcgatttccttcttttacttgtttctctctcagtactcttcaaaaagagaggtggtgaccagtgttggaagagatgaagcagatgcacatcacttcctttgggaacttgctgaaataattctttgcattgcattttcatttacattatgctgaccagttctcttcacttagaactttcttagttgttcttttgattcttactgttgaaaaccaagattatgctcttgtgatgaagtgttttcaaatatcaaaatctgaataattgggcagcccactttcagaatcttatcatgaagtttatgctgcaaaatgtcagtttaaattgaaatattcaaactagtagcaaggtaccaatgataagacatccacagacccaaaagttaactgaattcatatgctattttttgctgaacttatctaactggtagccatacacagcaataaataggctggcaattatgcatgggggaaaatggagtttcaagtgtgtagtatcatgtctataagaataatattaatgatagcctgaaagcccactcagatatctcacagagcctatactctgtaacttagctatcatatataatctgtcctggggatttacaaccctggcccaagaattaccaggcatctatgaaaatgcgacctagaacaccagttgccctagagaaaaagacgcctcagcataggtgcaaatttcatagatgttaaaacaaagctaacccttacaagaataacttaaactccttatatgaaataaacatctgataattgaccaggactgaatacagatgtaagaaaggggaagacctccccaaattccgagaatagtctccggaaggataccctcccagctatttggtggccatgccaccagcctgctcccactgtcttgtaagagcactgccacaataaaccacttgggaatcaggtgatgtctaagactcatctttgaagcgtatcctactgaagagaagaagttgcctctggagaagatggtcagctaggctcacctaagaccctggagtgcaatggcagaaaagataaaaaaaagcatttaatgatgatctgatgactaacaaagcaactaataaataagttaacttttaaaggtaaagatgaatcagatggtcagctttacttagaaatatttgagataggttgtcctaattaattaaccaacaaacacttattgagagaaagtgagtagattggaagtagactaacatttattgatactctacttgcatctggttctgtaggtttaattttcacaattctactgttatagaacctatcaaaagcttcaagtaataagtaatatagattgaatcagaatctgactttgaatactctgttttttggatcaatttgactttccaccattatatgtgtaaggctgctgtttcctcacattacctacctgtcctggctgattgtacctcctactattgtgtttcccattccttagtatctctggtttatttttcttattaaaataagccaaaactttccttttccaggtttttcattggttatttctttagccttccatttatatctcacatttcaactcaaattctccttccttagagaagcttcactgaccactctagttaccaaagaatgctgtcttcttaatagtatgtatcagtgcctgaaattttttgttgaaattttaatttcctgtcttcttacactgaaatgtaagctccctgaagcagtaaaataacaatgtctatatccctagtacataaaacattgtcctgcactaaaagtctttcttgttcatgccttcattcactttctcattctctctctctcgatagattagatagatagatagatagatagatagatagatagatagatactgagatagagatatagtgtgtatgtatctataactgatggactgatttttttaggtaatgttccttgtcaaggagttgaaaatataattgtaaagaaagtttaactaatatatgatacaactaacaattaaaacaatgtatagtatgtggaactcacctactgaattactgagaggacagagggttgcgttatgagggaatctgaggaatacagatatcacttcacatttcgtcagaatttcacagtttaacatatattttatttcatttgtgcctcataggagctgtgtgaaataaagagaattgtcttctttttttttttttttttgtcaaagaagtcaaatgacatctcaatccacaaatccagtggtaaggcaaggttccctaaagaagataaacttgctaaaaatactaccctcctttgtttatttttcagaaatttaaattgctactcttcattgagaaaattagagcaaatgatgagattttttaaatctgctactgtgagtacgtgtatgatatttgatgaagttagcttgctgaaggcatcatagatcaaatccctaaaacaagaaacattttgtggccttacatgtgtaggattggagggtgtatgcatacactttcagtatattctagaaatcagtgagctacagtgtgatgtcatacagatatatttggccactgaccaaaaataaaagcatgctatagaagcattcgtcttgaaacaatatacttgccaaactgtctttacattggaataagccaatatttttatattttatatgtgcaggcaatcaataaaaaattgctaaggaacagagtctctattcacagtcctctgcatggggcacggcccagtacacattaagttgacctactgcatgatgtccagtcagtattaaaagggcttaacgattaaaaaaaaatcagatgtttaacatgtaaaagataattaattggtacattcaaagtctctcattcttttttgggatcatcctctgtgcttgatttttacccaatatttcagagccatttctgccagtgatgaaaaactggagatgaggttgcttagacacagcaaatcctgtatagccaaagggaagctgaaggtcaaagagtgaattagattgatgtcttgttcttgttgaaaacagaatttatttgttttgctgacagagaaggaaaatataaacagtcaagaacgggaagacatattattttgctataaaatgaattcaagaggaaataacagatataaggaaaaacacagtgaatattattataggaataattcattagaatagagagacaatgaacttaaacacttgctaattctcctgctgaaatggatcaagtgattgcttcgactggagaaaaatcctaaactaacctaaatataaatgagtgctagaggacaggcagaatcacatcatgacacagacttaaaggcagagccagaagtacaataaagttaagacctgagctctccatataaaacaaaccttgtgtaacaagtgaaccacccaggtatgtctttaaatttatttttgaaacattagtttctgtccttaattattttctaataaaaataaaatcatttgataaaagaaatacaataataatatccaacgtgaataaagtctgaagactcagagggaaaatatttttttcaataactgtaatcatcgtatttctccaaaaatctcatttgcaaataatattgtgaaaaaaacaattttcgtgatataactcacaaggcagaagtctgatataaaacataaaatgtccttttgtttttcgttttgcatttatttcttatttcatcctgataaaaatgaatgcatgcagttttcaatatgagcaaataagtttttttccatatatcctttaaaactgtcttattcacttcgaatcttataaaatatattcatttaaattatatttatagaaaatcttcttgagaaattatgaaacttctaaatttgaggagatagtgacctaaattactttaaaggtaatcttgatcataatagaatgctgcagaagggctcaaagtttcacttttagaaagtaataaattgcatggcatttaacaggcctactctaaataagccacagccttgaaaagaaaattgctttagacactggtcctcttgccaatgtactgatttctattattagccaacatcttctaccggcccctgtctggggtcaccttaggtctagctgaagctgtatcctcagggccctgaatggattcagaatcagcatgcaacatgcttgtggtggcagtataaaacagtctacgtgagagaatggtccatgagagcaaaatcaatgtaaggataaatgaatgtagatgggatcaccaatcccaaatatgttacaagaagagagtgaacaaagtgacacggagactaagagaagataagaaaagaagtagaaagcaaacatagggtgagtattatggaatagttcttgagtaaaattcagtaactataaaattataattactatggctctatctgttaatgtagtgggctatttaataagccaaagcagcaaaaactagggcattactatggattagttctctgtgtgtttcctgaaacctagagaagattgtaggatataaactcaattgtgtcctagaaactcattttctatgttccagtcttgtaaattctacaaggttctagaaatctgtagtctaagaggcaataaacctaattatgaatatactaagacttagtcccttccaggaaaaagataaagaaaatactagtgaagattatttccttatgaaatgtaaacatggccttaatctagactaaaatacattttttcctaagaattttagggattaagatagattttctgtggtagtaacaggagcacagccgctaaatttatgccactagaagcaaggaagatcataggaaagatataacctgtcaactttgattcattttgagaaatcagtactcatgtaatgacggtaatggtatttatcgtatgtaaaataaaaccataataagcttttaaaatagtttaaggtacaaaagagtattttaaaaacaatgaatttgatctcttaaaatttattatagttttgtcacgagttttattagaagattttccatgtgttctttctgggagaaactatttaaaaagtccattaactttttctaaatgtttaattttttttttgagaaggaatctctctctgtcgcccccaatttttatttaacatgagttaccaaattagggtcactgcattcttattaactatgctagtttaaaaaaatttatagaaactttttaatgcttaaatatgccatcatatcactgccaacatttgtctctttttaatcaatatttaaagtaactatttccagtttttcattttaatgatttatatagtctttaaaaacattcataatggtttcagtggaagccatctctgtgttgatttttatgcttttatgtttctttctttttttgagacagagtcttgctctgtcacccaggcaagagtgcagtggcgcgatctcggctcactgcaacctccacctccccggttcaagcgattctccggcctcagcctcccaagtagctggaactactactactactacaggcatgcactagtagtagtactacgactactactactacaggcatgcaccatcacctctggctaatttttgtatttttagtagagacggggtttgggcattttggccaggctggtcttgaacacctgacctcaggtgatatgcccacgttggcctcccaaagtgtggggattacaggtgtgagccaccatgcccggcctgatttttatgcttttaaatggcttttggtctcattctttacagtaatgaccgctgttggtttgataatcaaccttcataatgttcaaacagtttatatttctgcacatattttctatttaaatactgacaagtattgtggtcttagtctcttagagacaaaataatcataaaatatttgttaggataaaaaactgttaggataaagacataaaaatgaagttttagaaggaaatgtagataactgtttgaaaatgtaaaatcagtgagaccttatttattgtaggataataaatagctattaaaaatatacagatttaacactacatgaaaatttaaacatttttataaaaaagctatcattaatatgatcaatggataaatgacagattttggaaaaatagcatttaccagaatgatttgtaatacctataataatactaatgaaaattaataataataatacttcaaatagataagaaaaagcatattgctaattgaaaaagacaaagttgttaataggcaaattacagatgagaaatacaaatgacctgtaagcatttggaaaaaaaaatgtttaggttcattagaatttttgggtgtagtggatgcaagtattaaaaataatgtattagatttgtacctgataacctgtaggaatttcctacaagtggtttttaaagtaaagcaagatacattaaaatgtgtatacaagtattctattcttaacacacatatgcatattacatctattttttataatataaagaattgaatgtcagagtacatatcagtgttggaggaagagaataaggaggaagcacagaaagtaaaaaggaaaaataggcaccaaaaaagatttggagaatggcagatggccaaggagatgcagctgggaagtgcctcttccatggagaggaacccaaatatccagtaaaccgtcacattttaaacagatcttttgagagaaaacactgaaagttgatacagaggtgacacagacaccatggttgaagagggaagaaatggggcagtctgctcagagtcactagacaccaggactggcccatataccttgaacaaacccaaggaaggggtgagtgaaggaaccctgggacactacatacccacaatgtacttctgagatcctagctacaggagtttctacgacccccatagatctttggactggtaggagagctgcctcgagcacatgcagaggcacagtttgaacccacaccgagcccagaaggctttgttgtgcggtgcagctgcagcaaaatgcaaccctaggtgcccatcccacaagtctccatttcatactgagtggctaagttcctgctatctgccaggctgggagtgaaccgtgcctggcctgctcacatgcccaagataggccccatcacccatgctgcgtgattaaggtacatctggtccacatgcccccttgcctgtcaacgccttcccagacctcatgcctgaccactcctgcaagagggtgtccacagcacaacatccactgcccagcttaagtgttttgttaacagcctgggagaagttcaccaccctgtccccaaatcatagccagtgcttaaagcttagaggccagaggacaaatcagtgagcccaggcccgtgagctcagtcccgtgagcccagtcccaactccccaagactccagtacaccacgcagggacattgagctgagatttgtgacctaatctcaagtgaaggaggaggatcctccacagtcagaatgcagagaagaatgtggtatgggttctcatggggcatgggagctggacacccctccctttgcaagaccagacaacgaaaggtatggcctgatggtcgtagctttttttccagggagtatcctggcacagaatgcctggagtagctcaacaatgtgggagcagatggcttggggaaagcctagttggttgggcttgccgccagggcgagtgtctgtgggagatctgctgggttaggggagtgtgagctaggcagacaccatggttgccagctgggctgaaaatcacgggctgcaagctccatactggtgttgcacccattgtggcactgccctgcctggagatcctctacccttgaaatactgcattttctttgtctctacacttgaaatactgtattttctttgtctcatgttgtgttttgagacagtacaactcatacctaagttgtgtatcacagcaactgcggacataccctaaaacctgctctgactttggtaagcacagtagactggtgggtctctggagagttgtgtccctagagatgtaatcctcagtgtggaccactcctgagggaaggggagtgcagcctgccaaagcacaccatgagataaagaaaatgtggccatggcatcagccactaaaagggtcaccaccaaggcccagaaccagacttggagaaggaatcatgtcttgcctccatctccacttcccagtgcactgttgcggatgcagcagtagctcttcccataaggtcctagaaagtgtgcactgaaagaagttgtttctcatgatgctccagtgaggacaagcatgcaccaagaccccacctgccagctcttactcttaaatctgtctaccagattgaagtttgaattatagcatcacataaaaatacattgctaaaacaagcaacatctatgaaagccactgcaggaacctatctctaaccaaggaacatatatagaaacttcacccctgcaactacccagaaatgaagccaatgaatcacatacaccacagtcatactttcaaggagaataaaaaatataaaagccctgtgatggttaatattgagtgtcaacttgattgtattaaaggatgcaaaatattgttcctgggtgtgttttgagagtgttgccaaaggagattaacatttgagtctggactaggagaggcagaaccactctcaatctgggtgggcaccatctaatcagctgccagcacagctaggataaagcaggcaggagaagacagaagagcagacttactgagtctcctggctttcatctttatcccatgctggatgcttccagttcttcagattttggacttttgtacttacaccagtggtttgccaggggctctcaggccttcagtcacagactgaaggctgcacatcagcttccctacttttgaggctttgggactcggactgccttccctgctcctcagcttgcagatggcctattgtgggactttaacttgtgattgtgtgagtcagtgatccttaataaactccccttcaaatgtacatctatcctactacttcagtacctatagagaactctgactaatacaaaccccatctaaatgaagcaaattcaaaaacaaagtatcaactcccgcagatggaaaggaataagcacaagaactctggcaatacaaaaagccagagtgttttgtggtctccaaagcctctcactagctccctagaaaaggatcctaaccagatgtaaatgtctgaaatgagagacatagaactcagaagatggatggcaaggaaagtcaatgagacataagataaaattgaaatccaatacaaagaagccagaaaaacagtccgaatttgaaagacaacatagctatattaagaaagagccaaactgaacttctggaactgaaaaattcactaaataaatttcgaaatacggttgggagtcttaaaaacagactaggccaagtagaaggaaaaaattcatagcttgaagactgattcttcaaattaacccagtcttgcaaaaataaagaaaaaatattttttaaaaagacaaagccttcaagaaatatgggattatgtaaagaaaccaattctacaacttattgatattcctgagagaaaagaaaaaataaccaacttggaaaacatacctgaggaaaaatttcaagaaaatattctcaattttgttagagatgttgacatgcatacatcagaaatccagagaaccccttttatatactataaagacagccatccccaagacacatagtcattagactatccaaggttaacacaaaagaaaaaacaaatctcagacacagctagagaaaagagcaacactacccacaaagggaaccccatcagactaactggtcttctcagaagaaaccttacaatccagcagagattagaggtctatttttagtactctaaaagaaaagacattccagaaaaaaacattcatattcttcaaaactaagcttcataaacgaaagagaaatggagtctttctgagtcaagcaatcggtaagggaatttatcaccaccagactagccctgcagaaatgcttaagggagttctaaatgtggatgtgaaagaacaatacacacaaaagcagagttaagtacatagtccacagactctataccacagactctataaagcaactacacaattgagactgcaaagaaactagctaacaaaactatggcaggaacaaaatctcacatataaaagttaaccttggacataaatggcctaaatccttcacttaaaagacatagagtggtgaattggaattaaaaaaaaaaaaaagaatcatccatctgctgtcttcaagagacccatctcataagtaatgacactcatgggttcaaagtaaagggatagagaaagattaatcatgcaaatggaaaacaaaaaagagcaggagtttctattctatcagaaaaaacagatcttaagcctaaaacagaaataaggacaaaaaatgttattgcttaatgacaaagggctcaattcaacaagaataattaactatcttaaataaatatgcacccaacattaattggagcaccaagattcataaagaaatcactactagacctaagaaaagatgtagacagcccctcagtaataactggggacttctacacccaactgacagtggtagatagatttatcgaggcagaaatctaaacaaataaattctggacttaaatttgacacttgaccaattaaacctaatacacatctacagaacactctacccaacaaaccacaaaatatatatttttctcatcttcacatggaacatactctaagagtgatcacatatgcagtcataaagcaagtgtcaagaaattaaaaaaaatattaaataataccaagcatcctcttggaccacagtagaataaaaataaaaatcaatagcaagaggaactctaaaacgcagacacaaacacacacacacacacatacacacacacacagaaactaaacaaattactcttgaatgactttcatttgggtaaacaagaaaattaaggcagaaatcaaagaactttttaaacaaatgaaaacagagacacaatgaacaaaaacctctgggatgcaacgatagcagtttaaagaggaaaaattatagtgctaaatacatcaaaaagacagaaatatatcaaattaacaacgtaacattgcacctaaagaaattaataaaacaagaaaaaaactatatccaaatatagcataagaaaataaataacaaaaataagaacaggactgaacaaaatcgagattcaaaaatccatacaaaggatcaacaaaatgaaaagttggttctttgaaagtttaaacaaaattgatagactgctagcaagattaacaaaaaagagaagatccaaataagcacaatcagcaataacaaaggcaacattagatccagtcccatagagattcaaaagattctcagagactactatgaacatttctatgtgcacaactagataacctaggagaaatggataccttcctggaaacacacaacctctcaagattgaaccaggaagaacttgaaacactgaacacaccaacaatgagttacagaattgaataagtaatagaagtccgggactagatgaattcatagctgaattctaccagacatacaaagaggagctcatgccaatcctactgaaactattccaaaaaatcgaggatgagagattcttctctaacttactgtacaaaacctatatcatcctgataccaaaatatggcaaatacacacacacaaaagaaaaccctaggccaatatatctgatgaacatagatgaaaaaatcctcaacaaagtacttgcaaaccacatccagcagcacatcaaaaagataatacaatatcaagtgaactttattcctgggatgcaagggttgttcaatatatgcaaatcaattaatgtgatttatcacataaagagaattaaaaatgaaaaaaataagattatctcaacagatacgttaaagtatttgataaaatccaacatgccttcataattaaaaccctcagtagactaggcatttaaagaacatactaaaataataagaaccatctattgacaaacccagtctacattatactaaataggcaaaagttggaggaattctcataagaacaagaacaaaacaagaatatccacttttaccactcttattcaacttaatacttgaagccctagccagaatgatcgaccaacagcaagaaataatagacatccaaataggaaaagaggaagttaaattttatttcttcactgatgataggattctatacctagaaaaccctaatgattctgaccaaagacgcctaaagttgattaaaaatttcagtaaagttttaagataggcaatcaacatacaaaaagcagtagtatttctatacaatgcaatgttcaaactgagaaccaaatcaagaacacaatcccatttatgagagccacaagagaaaaaaatgaaatacttaggaatacctctaaccaaggaggtgaaagatctctttaagtcgaactacaaaacactgctgaatgaaatcatagatgacacaaacaaatggaaaaatattacatgcttatagattggaagattcaacatcattaaaatgtctttactgcccgaagcaatctacaaattcaatgcagttcctatgaaactgccaaaatcattttttacacagaattagaaaattgattctaaaatttatatttaactaaaaaagagcctgaatagccaacacaatcttaagctaaaagaacacagacaggggcaacacattacctgacttcaacctatactacaaggctacaataaccaaaatagcatggtatgggtacaaaaatagacacatagaccaatggaacagaatagagaatccagaaatgaggcctcattcctacaaccaactgatctttaacataattgataaaaatgcaatagggaaaggataccctattcaattaatagtgctgggaaaactggctaaccatattcagaagaatgaaattaggctcctgtctctgaccatataaaaaaattaactcaagattgataaaagacttaaatgtaaaactttaaactataagaagcctagaattagacctaagaaactcttttggacattgacgtaggcaaagaatttatgactaagtactaaaacacaaaagcaacaaaaaacaaaaattgacaagtgagaccaaattaaactaaagagcttctgcacagcacttgcatgttctattgcaaatatgaaatagcaaaggcatggaatcaacattggtttccaacaatggtggattgtataaagaaactgtgatgcatatataccatggaatactatgcatccagaagaaagaatgaaatcctttcctttgcagtaacatggatgtgcctggatgccattatgctaagcagatgctgggacacaagaaaaatctttaagatatgtcactgcttcttatcaataataatgttctagtgagtaacaagagttaagaacaccactaattatagtactgtaaatataattacagttctaataagacatacacacacagagaacaattttgtctggtggttgaggaaatcttcattgatttaagatattttttgatgaacaggatttttcaataactatcagacgaagaatgtctatgacttatttttaaaaactattttcttctctgccttgcatatctgacattttcatctcctatcttccttgaatacaatatagaacctgacatttctttcctttcaaagatccttaaaacatttcctacatttaatctgaatgtctttctcagtaatttttcttatacaagcaattatggctacattttcttaatataatcatgaaaaagtgagcaactgaaaatttaatctggagaatatatatgaaacatattcaattaattcaagttgttgttaggctgcatatgttcagctttcagtgaaggtgattgataaatgagaaactgaaagaaaacaaaccaataggtgtttttcagaaacagtattattaaaatgcatgtgctttctactgaatgaaagcaatatagactttttcctcgcattggtagttagtaaggtgtataaaaacgactttgtaaagaacaattaatataggttaatgaatcactgtgaagaggggataacactttattctagcaatgatctgcaaggtgttaaaagttaaaaaagatgaaaaacaattgaatagttatttcatcatagtgtttattaaattgattttcctgtatctgtcaagctttacagaaatgtcttcaacagaataacagtgttggaagccaaatgaaatgcattatgaaatatgattcttcacttggtatgcaggtatactctcaggtgttaactcaggcaaagagacaaattcaattttaaagttccatttgttaaaatttgatgattgtgattaaagacccataacaattctatctttgacattttagttttttcttcacagaagcattctactgcaattttcttagttttctttcctcttaactgtggtattacccataaatgctggatttctctgttttaagtgtaacaaacctacaatcaactatttctggaacaccacttcatcttaacaacaaggacccataaatattctaaaaattcaaagtgttttatataaaatgttaaatgatacacataataaatttctaagtagtaattatgattatgcccataattatacccataatttaaaaatatgttacctgaagtaaattattacatattttatgttggaagtattcatttatctttgatctcttttaacacactgtactaggtggtaataaaataaactgccttattgggtagtcatttatcttttgtttcatattttttactggactaatattccaacgctatagatagtgaaatataacattcaaacaatttgatagtagtcaatgaatccagtttttaaaaatgggatccattttctaaaattgagtatatagatacttcatgaaatgtcttatcatacatcctaaaccaaaccaacctcttcccttgactgtcttacagtgcgttattattttatccactgcagcaactagcacatttttcagaacctagtagatattcagtcattgtctatggaatacatgaacacattctaaatttggacagtcatcattcttggtgttttaaaacaaacacttcctgaattgcacaaactattttctaaatagccctgggaattcattgaaggaaggtatgggtaagttgggggtcaaactataaagatgtaggttctcctctcaaaacttcttcagcgtatcctcattgttgtttgtttgcttgcttgcttgttttgaaagatctagatatagtctaatgagagttgtataaatgtgatgttccacaatgattctaacttacatggtgcaaaataataaaatattacattctagctgtttgtggaaaatcagggataatataaaggatctagattttctctctcctctcctcctaagatttattcactcagcaaagttacctggtgactacttactgctagacactgttttagatacttgggctataacgttgataagaacagggcttgaattagtgaaaagtttattttaattagctgtatggcaaaataggaaactaacaaaaataaacatataacatgtcagatggcaatggctgcactgagaaaaatgaaggagaataagaagttctaaattattatatatgaccaatattaccaacatattatagaaagaaatgagttcataatgtttatcagagaatttcatgaaaatcactaaatttttccagaaagccaggcactgataagggaataaacaaacagataaccgattttaatttgatcttctcttacaagtgcagctatgatctgccattgtatataatttaaattttaaaattgtttatatttctttcacataattatgttcttacattttgtttgtttgtttgttttgagacagagtgtcgctctgtcacctaggctgaagtacaatggtgcgatctcggctcactgcaacctccacctcccgggttcaagcgattctcctgctccagcctcctgagtagctgggactataagcaggagcccccacgcccggctaatttttgtactttattagagacagggtgtcaccaaattggcgaggctggtttcgaactcctgatctcagattatcagcctgtgcctcagcctccaatagatgctgggattacaggcgtgagccactgtgcctggccaatattcttacatttaaagatcagacatctatcagattcccttctccctgctacaaacattgtatacttttccataggcacaagattttgttttcattcaggttggactcaacaagtattatttagcagttcattgcatttatccatttacccaatagaggaagtataaaagatacagatgaataaagtgtaataattcttatactcactatttgcccttacatcatgtaagtgctcaactgtacaacatgtttgtgttcccaaaacctaactggaagggataactcagaaaaatagaataaaagtattgtatatctcatacatcttcattttagaatattgtaggggtacagatcagtataaataaaatactttggtaagtgcccaccacatcatctgtttgtcatccttagagccagattataccattctcattaagaaagaaaacttactactgtacctcctacccagtaacatatatatgatatatatatatcatatatatatattttatatataatatattatatatatatataaaacatttgctactggttaggagtaacactcagaaaatcatacttaataatgtagtacaattgggtataaattcacctagtatttttaaattttatgtatattcatatttatatgaatcatcatttaaaatcatgtctactgatcctgatggcattaaaggcataagaggtaccgaggatattaatttaattttgtttacagctatgcacagatatttttagttcactcagatttaatccagtagtctattatttgattaattgtacagctatcaaatcattcaggactcccactgtttcaacaagagtggaaaaatattttttcatttatgtttatatgcagctatttgtagtctaaattaatattctggcaattgatggtgaaattaaaattatttctgtcagatatggtaatttgatgacagtggataagcatgggagtaagagaaagttttgaggaagaggggtactttttgtttacttaatgattattcaaaagatgttaagtaaacattctatagaatgctacagatagtggaatacaacattgaaacaatttaataatgcagtcaatgaatccagtttttaaaaatgggatccgttttctaaaactgagcatacagacacttcatgagatgctttatcacgcatcctaaaccaaaccaactccttcccttgactgtcttacagtgcatagggtatctctacattctaggaaaggaattatctgtttatatgccacttataaaatcatacttaataatatagtacacttaggcataatttcacttagcatttttaaatgtaaaatgttaacgaaaagtgttcttgaaaaatatttctgagaatattttctaaaaaatgaacaaatcgtaacacctaagggatgatatctttctagtgaattgattatcagagtataatgtggtatgttctgattatgttacataatattctgattagcagaacattttaaataagtgaatttagcaaaatatttagaggttaaggaaactgttttacactgactatgttttctgacccaaatgtgagaaagaacccaataaaaagaggcagccagataatgctgttgtttgtgaacttaaacagaagcttgcatgtaatttattgttcaaagaaaaataaaaatagaagttatactttatttagaacttaatgacagtgaaaattacataaaaaggaagactactgaatacagcaaaagctgaaattatataggaaatataaatataaacacacaaaataagtgtaaattataatgaagtaaaaatatatcaaagagaaaaaaggaagtagtacagtaaaaaaaaaaaggtgatgctttaaaaactgtaattaaatagacaaatttccagccagattgatgaccaagtaaagagaaaaggaaggagacagatcaaaagacacaagatgatgaatgaaaagggggtcagcacttataaatgtagtagcaatgtaagccataatgagcacaagaaaacattatcaacttaattttgaatatataaaatagagacacttaaaaaaactgaacaaaaacaacttactagttttaaaagaaaaaaaagtcatcaaacatatatccttccaaaagtatagacttcaaaagtatagccccagatgggtgaacaacttcaaaagtacagtcccggatgggtgaacataaaccacactttaagcaagaactctcagttataactgcttgcaattttagaggataacagccacactcctgaaccagagcttggcaccggctattccctctggaacacccttttatttccttctctaagcaaagacatggaatcaatctaaatgcccaccagtggtctgcgggataaagaaaatatggtatataaacatcatggcatactatgcagctataaaaaagaacaagatcttgttctttgcagggatgtggatgtagttggaggccattatccttagcaaactaccacaggaaaagaagaccaaacactgcatgctctaactcataagtaggagctaaattatgagaacacatggacacatagagtgggggacagcacacactggggctttttggagggtggagagttggaggagggagaagacaaaaaaaataactaatggttactaggcttaataccggggtgatgaaataatctgtacaacaaaccaccatgatacgagtttacgtatgtaatgaacctgcacttgtacccctaaacttaaaagttaaaaatgaatgaagcctgtcagaaccacccactttgtagtcttacattttccctagtattcccaaacccctttgcctagtcaacattttacaaagcgcttttcatcttctactgtgttataatttatatatttttagtgtatattttacacactttattagaatatgagttccttcaaggtaaggactgttgtttgttttgtgctccctgatgtattttcagagcctagaacagggcctggaataaaataagcagccaacactatgcgatgaaaattttttggtgggtataaatgcctttgattcgaaacaaaactcagtttaattgtgtgtgtgtgtgtgtgtgtgtgtgtgtgtgtgtgtgtgtctaaagtcaccctaagcacactgttaataaccctagaatgactgacgtgttcgtattatgcaattttttatttttttcatcatattgacagataaaggattctaattcctataccttttcaataatgcagaagccttcataacatttaaattccattcatggtaaagattcttagcaaataaagaataaattgaaccttgatcaattactttaaagtagttataaaagacctatagtgaatatcatacttcagtattagaagctttctctttaaaataaggaacaagacaaataattggcaacatgacttcttttcaaattgcacagcattagggatccaagccataaaagaaaataaaagacatgtggatcataaagaaaatataaaacgttacttacagacaataaagttgtctgcataaagattataagagaaagctaaaaactattacagtcaaaaagagacatcagcaagcttggtggaaacaaaacaaacaagtacaagttgtcagtgacctttcaacaaccaattaggaaaaaaatatatatatacgttaaatcttaacactgaaaagcaacaaaaatatggaaacagtgcttcttatatgccagattctgattgaaatattttacaagtttaactcatttaattttcccagtgattcttgaggtagaggccatatttttcttaactttaatagatgcagaaactgaagcacagagagcacttgacttgcctaaggtaaaagttaaaaggcggcagatgtagaattcattcacaacaatctagatccagagtatttcttgtgcccctgatgatatgccaattctctggactctatcactaactctattaaatgatcaagaacttgaaagaaaaaaatatttaaattagtccatgaacaggaaatgtccaagtcataaacctagtaatatttcccaaagataatgcttaatagtggtgtcattacaaccaaaatactaaaaaaatgtgcaagccaatctcaaatatgtgggagagaaaacccaatactaatttgaagaggataaaagagcaaggcatctcccttgctgacagaaaggcttcttataactacaacattcatactgaaatgctattatactagatctagcactgaaacaatccaggccactacaaatgaatgaaaaatgagtccagaaaaacacagatccatatatgaaaatttgttttataacagaaattgcattaacaaatcagaggttaaattttaaaaaccataaaatatttcagacaattaattatttatgtggaaaaaagtaaagttgactcattatcctgcccagtacacaaaaatcaattccaggtggacttaaaaacataatgcaaaagcaaaactttaacataattaccaaaaatgtaagtcatcatctttatggtatttaaataaaaaaaagacttctttaaaaagacacaaagaaagcaaaacccataaagagaaaaactgatactcttgaagatgttcaagtttaaaactcatgcaaaatagcaccaaaaacaaggtgaaaaggaagcttcacagaggtactagataattctgctatgtttaactagcaaataattagtatccagaataaataagaaagcaatacatcactaagaaagtgacacacaaccctatagaaaaatgggaaaaaatatgaattggtaattcacaaaagagaaaatccaactgaatactaaatattataagagaatgttgaacaagtcaaactattaaagcaatacaaattaaattgccaataacattattttattcccatcctattgaaaacaattaaaaattctgaataccatgtggtggtgaaaatgtgatttcatgagtatatagcaatttggacagcaaactgacagcatgtgagatagttgatgatattcatatgacccagaaattccactattctagaaaataatcttgtacatatatataataaaatctatataagaatgtatactgcaacattttaaaattcaattaaagattagaaaagctctaaatgtatcaaaacaaagaacttgaaaaacagattataaataaatttatacagtggaagtcagtaaactgataaatcacaaaaacataagtttgagtaacaacatcaagttgcagtagacatgttcagtatatcatttccacaaattaacaaaataaatagtgctatatttttatggctataacacataaaggaaatatacatatgactttctagataggtattatttcttgtatctacaagtagaaaatggggttgcgcagagagggtgatagctacaattgcttctgtaattattctctttaaaatgatctgactcacaaacttaagagctggtggaaattcagcacgttttttttcctctttttctctccctgaaaagcatggaggtgttgtcactctcttcctgagtccctcagtgagcagacgtagagaaaaataccctaactgatctggaagtggaagatttaagttaaataaccttcaggaaaaaaggccttaaactgttttaaggcactaatattaaggtggtttcattgttacaggataacctagcatacgctgactgctattagaattcctgccatgaatcctaaaatatatgatatagtcttagtgatcattgggtgagtggcaaagcaactataactaaagctgaaagcatggtaatacatcttccgcagtgacaggatatttgataagactttcaccagcaaaaatatggaaggtacatgacattcctaataaaattgtagttccaagagaaggatggccagatttagcaaataaaattgcaaggcattcagttaaatttgatttccagatataaaacagatattattgtttagtaaaatttccatgtgatattatactaaatgattatacatatttgtactaaagaaaaacagtgttgtttacccgaaattcaaatttaactggttttctgtgttttacctggcaatcccatcaagagggagacgttgtgaaatagaaaagtagcaatatttcttggttactataaaagttatttaacaagactttataagggaacatgaagtcagagaagggggcaaaacactagtcattttaaaaactaggtggggaaatttggaagtagaggtgaccagatttcacagaagattgtagggtgagaggagtatagaggaagccaatataatacatcaaggtttatggtttgaaaaatggaaagatggaatatcaattacctgaaatgaagaaaatagcacacatttgtaatttgagttgcttattagcacccaactagagatatcaaatagatagttgaatatctacatctttgaattcaggagagagattcaaactgaagacataaatatggacattgacagcatatagatgacagtatactaagtttataaagataaaatagtaataaaagctaatattaacctcttttgtgtcagtccttgatgtaaatttttttatgtgttaactcactgagtccccacaataggtcgatgtaattggttctactataactacactctttaaaaatggatattttagtaaaaagaaggactcaatttatactcaccctcaatttgtagccattggtgtcatctctaagacaatttttagtaattgcctagtcagtgaaccttgccatagtccttagttatgtaaatttattgtattttttggaattccttttcattagccataacgctttaataacatatttttaaaattttgactttaacatctatattgtagtgaatatttaaagaacttcctccaagtttaggatacagaaatgggtaaattatgtctactccctcatatttcactattaagatgatggtaaattagcagtccaagagatcatggtcctgaaagtacagagaaaaaaatagaacccagtgacccaacataactaaggagcatatttgagacattgtcattcttggtatttctgaagaagcactgggatggaagggagttgagatcattttgtcagctacagcactaaattttggtcatgaatatcaaagtgattccatctttatgaggagcctgtggagaatggcaacatgctatatgtatacattttagaatggattaattgccatctgcgtaccttttatcaggttattctatttgttcagcatgccccaagatctcttttgtactttacaaatctgcacttcaattcttcttagttcgagactcacttcaacctaccgcatccttagttttctgcacttacttgttgtttctaaaaaagtatacatgatattatacaataaacatctagaattatacatttatgtactatattcacagaaattggacttgcctttaagccctcctttttacatatattcctgttattgtctcactgctaagtaatattactggatggcaaaataaaccaaaaaacacaaattgattttaatgaaaaatatcaatattaaatattagcttaaataacacaaataagtaaatattgaaatagatgggcatgttaggctgggcagctttttgtgggcacaatcatacaatttcaacttcaaattccatcatataacaggatgttctattggtacaatatctccttgttcacatgaggaaattaagtatattgatattcaccgaacaccaatttttaaatgtatttgaaattaattattttaagtgtctctcaactctcccaatagtgcacaaatatgtagttatgctatatactaataattaaataactttggaaactcacaacttcaaaaaaatgttcgctgttgtggaaagtttccgcagtagagaagggaatgtgaatggtatcagtcttagataacaagaaaactactttactttgtttcaactctactcatttgccatccaaatatgatagaagatgctgctcattcctaacaaatatttccagatatcatgcattccttaaaggagatgatactgattgccctctctattttcactcactttcccattacaattagcagcagattcttttaattatccctgcccttcttaaagcagtctcagatatataaaaattaattgcctggaactcacatctttataattttaaccttttcatgcttcacttatttacggtgacatttatctaaaacacttatcaggtgactgcgcatggtagacatctggtttatcagaaaaggcaggagaaaaaataaatgtaggacattaagcttgctatggtgctttgagactttcctagaaatcgttagctcatcaaaacttgttttggcatggcagaaagacatgtcccattaaaaggatattaatgcaagatcaccattgtcattaaaccatcataccatatattacacatttatgctgaaaatgggttcaaactttttattcccttatcctttaattattagaagaaactttgcagattatagccagataatttaaaataataaaatcaatgtcacttacaaggtcacaggatttagtaaaaccctgctacccatttccttttaagtaacttcgcattttagaaatgaagactgcctattcatgtggcttctgtgattttgttaaacattaattaacaaaatttctagtttttttttttttttcttctagagcagttcagtggaatgaaagaccttttttatcctatgcctctaaccacaaccgggtgtctctatcttaaaagatatttatcaagtctctgcttcatatttccttctctacaccattacagtcctcagcaagccctgctatctcatgatcgcaaatcttggccctttattgttggtcttctttctttcattgctacatgttagaataaatggtgtaagagaatgcttttatctattcaatttctttctctttggctcctgacccactgtctttgtttcagaataattatcagtgcctatatattaccttcacatatgaggcctttgttcgtttcattctttccatctcaattttctgtacattcgtattctctaaagtcttcatctctgtcaattgttcccttatctccctcaagtggacactgtcggcttttcgtagatgttcctactcaaaagagatcttgcaagccagtattttacattaagtaattgttctatttctcgacttttgctggcctataaatataacacatataaaggtagccattgcaggcacagtaaattatttgtctatgaaatcacaatgtttgccccagtatcttaatacaactctcaaatttatataattttttaatttaaaaatttaaaaataactttgcttaaacaaaggcagtttgttttctaacttatctatgtgtgtatgtatatatacacagaaatgtatatgtatacacacatatatattcataaattattgaaagtttcatgcaaattttttactttgccaatatgccccaaaacttgatatgaaattaattatacgaaggagtacagccttgtctttaattagctagaaaaattctcagcccacttaaataaactgttcccaacttggggagataaatttaaatatcttatcttggcaacgaacttataacccttaaaaacatttgctatggcatctatatattatatttcccttgatgtgaaaaataagaaacatttcagaaaaacccacaattaaagaatatcacctggcatcatgtctaaaaatgtataacagtaaaatagaaaagatttgtggatatgacaacaattctgcttgctttcaaaattattttttgctttgttttttgcaaagcctaattaaattaatatatgaatattgagtctattaatcttctctcttaaaaattcaaagcactattttaaagtaaattatcttaggaatattatctaagaatgaacttcatgtggtaaataccagcataagtcattactaaatgtgtttagggtatacaatggaagcagagtctgctgctaggaaaaattgaccttttgttttacaatttataatttatttagtgcagtatttgaaaatcatatttagatataacaggtgacaagagagctctatactaggaaagataattttagtactaccatctataaaagagactaataaatatgaaatgaagatgctataattaaactgtaactcttgcccatgccagcccaacataactattataaaattgtacataactatcaggctgttaatttgaggtaatattgcaggcactacaaaaaaaattcagtaactcatcaaaactattttcttatgaaggtaataaaagctacaatacctgcccatgtcaattatttaaaggtgttcgaagcaaatttcttaaataatttaatttctggagccagacataacagttgactttgtgctctttgacatttactactacagactgttgctaagtccaggcttcaagaactctcctgcatttattctttttaaatcaatggtacaaattatctaactagctatatgtgacgacagcagtggttctcagtttggttttaacaccacctggaaacctgcaaagtctcaggtttcaccccaggtctaccgaatcagaaacactagggataagccccaacaatcactgttttagtaggatcttcaagtgatttcaatgcaggttaagtctgaaaacactggaaaagaggagagaaaaagagagagagagaggagagatggagacaaattcccagaccatacactgcactagaaatagagtgttaggactttacaacaggttcaaaattttagagatgaattatagctgacatttgaacacaaaggaaaggagcccattagtccagggaacatctctgattataaacaacttcatttcctgcttaggtattattcaaatgtatatttaacagtataatgcttctctacaatcaagtaaagctcaaacaaatttaagatgtctttttttttaatgttgtatgttgatgagatttaaactaatagaggcttagctcaattggtgattaaggtgatgagtctgccctggaggtggaaataaatatttcattagacttgtgatgaattctagataattttgacactactagaatgattttgaaagtctggatgatttttgaccaaatatagacccaaatacaaatattgtgaataaaagtattgctaggatttagaaactttaacaagttacataatgtttaaattcatgatttctgtgggtaatttgtggtcagtgctttggggggcagaatgttaaagagatttctatatgagattatgagtaaaactttgtgacaaacaatttgaaaaaatagttgaaaagaagaattcagtaggtaaagttaaaaaagtagaccttactatgaaaaaaagagtagggatatatagaaaatttagatattacgagttgaatgtgtgcagacttcccaagatctatgaatgctataaggaccactacagttgatagcgtagagaaactaaggcaatatttatgcagtgttttagaaggccacagctccattccattactatctgatgatattttagcaaagctggactctgcagtatccttttttgtttgaagaggaatagtagaaggagcatttgtcactcttatttcaccttcaacttctcattatttcccatacacgctcctgttacaattcttgggaaataattaaaataaacttacagccttttatatgggtaatttaaccatatttactagtgtttaaatgattcaaccactgctaggctgtgtagaaaatacaagtactggtagttgtgtgaaagttagctgagtttagataagaggtggcctgaaaagtcaagtctcactagagcactgagattttaaaactattctctgggaactagctagctagctagctagatagatatagatgtttctcaataacaacaataaagaaaattatttcttcatgtatttattacaataagcaaaatattgactaataaaaacacaagaaaggaaaaatactaacaaaaaacatcctgaatactctatatactaaagtgtaataccaaaataaaaattagacacttagcattttctgtgagataaaatagaccaagcaatgagcctcgcttgatgcttcatacaccaggagagctggaaggatgcacaggttcagtaaaaacatgccaaaattaacatgagaagacatgattttatttacttatttatttattttttagagacagggtctcactctttcacctgggctgggatgcattggcacaatcagagttcactggagcctcaagttcttgggctcaagcctcctgagtaactaagactacaggtgcatgccactatgcccaaataattttaaaaaaatttttaacagaaacggagtctcactaagttgctcaggctggtcttgaactcctggcctcaacccatcctttcatctcggcctccctaagtgctggaattacagtcatgagccatggtgcccggcctaataaatgattttcaataaattatatttaacaaaatggattagaattaaccaaaaaataaaactagtaattcaaagctttaaggagtggatgtaggtatgtatctacgcatggatgtctgttaattttgtttctttttaaatcagagaaaacaaatttgaaaagatgctttgaaagtagctgccttcttattgtaattgttttaccaaatagcaaagtctagttcttcaaaattgtcagaacctgttatttatactccatttattcttatgattgggcaatgtgtggcacatttaaggattattttccagtatatcataaatatattaacaatgtgacactttaaggatctaaggaggactgaaaattttatctgaggaattcgttagtctatcacagaggtagctctttgatacctaagtcatcaccttttatagaacgtaacataaaggttgaagttttcacagaataagtaatactgtgaattttcagatagagtgtaaactcctctgggttggctggcttttctgtccttacagagctgcccattgtggtcaaattgaccacatgagaagttgatgatgcagttatgccatgcatagcaaccgcagcaggccttcctcattccaatgtaaatattcattatatgaagcattatctaagacccttttgccttgaaagagagagtaaaaaattaatcaggagtagagtctctaaaatattcatttccctggttcatggagtcatacaagcttctttatcatctcagcattttagtctagtccaaaagcccaaagactaaataaagtaattgatacatggcatccatgaaaataatacaagtaaaatatggctttatgttgactatgcaaatttcatatgaaagaaattgtttccaagaaacttaactcaataaaatttaaaccataaatatttttcaccaattttattcaataaatacttactgagaacctactgtttcctggccttgttatacttgtttggaattcatttgagaagtcaaccatataatacttcatgacattggtctaggcacaggtttttttggataaaaacttaaaagcacaaacagtgaaagaaaatttaaaggcatcttaacagaaaaaaaaaacaatcagcagagtaaagagacaacctaagaacaggaaaaaatatttccaaaccatgtatcagataagatattaatatccaaaatatataaggaactcaaacaactcaatagcaagaaaacaaataacctgattaaacaatgggcaaaaaaatctgaatagatatttctcaaaagaagacatcaaaatagccaacagatatatgaaaaatatatttaacattactaatcttctgggaaatgcacataaaaaccacaatatcatctcatcccaattcgaatattatcaaatagacaaaaaataacaaataatggcggggatgtaggaaaagggaaactctattacactgtttgtgggaatgtaaattagtacagtgtttatgaaaaacaatatggaggttcctctaaaaattaacaatagaactaccatatgatccagtcattctactactgggtacacatccaaaggaaatgaaatcagtatgtcttagagatatccacttccatgtttattgcagcactattcacaatagccaagatatgaaccaacctaattgttcatcaactgataaatgaataaagaaaatgtggtatatatacacaatggaataccattcagccataaaaaaataaatcctgttattcaaggcaacataaaagaacctgaaatgaaataagccaggcacagaaagacaaataccacttgatctcactcacatggaatttaaaagagctgatttcatagtagagagtaaaacagcagttgctagagactgagaagtagagtgagaaggaaagatggagagagactggtcaaaaaattcaaagttacatttgcacaggatgaataagttctggtgctttattgcacattagagtgattatggtaaaaagtattgtattgtatgtttcaaaatacttagaagaaagaattttgaatgtttttaccacaaacaaaatgataactgtgtgagatgatggatatgctgtataccctgaaaagattattacataatgtatagatgtaggaaacatcacactataccccataaatatgcataattattatgtgtcaaaaacaaaatttttaaaagttaatcactctctaatgaaagtatcttttggctcctagacacctgattttttttttccattttgccaaaagtcaaattctacatactaaaacaaagaatttattgtatcctttcaaaacaatatattttaatagcatctatagattcatcaagcaatgatgtaatgaacacaataaaagcttgagtaatctaactactttacaatagaaattgtaatgtttttgtttttgttttgtacgttcaatcctctgaaaaacatgactcttcctgatttttttttcttttttgaaaggagtcttgctctattgctcagtctggagtgcggtagcacgatctcagctcactgcaacctccgcctcctgagttcaagcaattcttcctgcctcagcctccagagtagcttggattacaagcaccaccaccttgccaggctaatttttgtatttttttagtagagacggggttttgccatgttggccaggctggtgttgaactcctgacctctggtgatccacccacctcccaaagtgctgggattataggcgtgagccactgtgactggccaatattttaaatgttaatgtctatcattatattttctcattctcttttgctgtacttattaaatggtctattatcctagaaaataggtaagaagatgaaaaacaaaccagtagcataagatctgaaactgattgataagttatacattaaatatatgatttgatttgcttaagacctctagtatttctattccttttttaatttttagagtttcaaaatttcattataattttggttaaatttactgacttctcaaaacttctaaagtttaatgaactatatacccatcagtgtattaagcagaaaaatagtttagaaaattgtcaccaaagtatgcactttgtatctgaaaacaataatgaggcttctctctgaccattaatcttgggcttttatgacacacaacaattttactattttgtttatttgcttggtttatagtacatgaagacagaaatattatagtttctgtttcatgtagcacatttctttaaaaatgtgttttaaaatgcctttttttctgcaaaactgaattccagtacctaatttctctgttactttggtgggccaggagtcctgccgagaagaatattgatgtctctctcatcagaggtttttgataatgtcaggtttccaatatatcctaggggtatatttttacctttttaaaacaaaatttatttttgcctatttttttcgttctaaggctctttatgacaggactatttaaagcactgaggacaagacaagatgtttatatatacttcctgctgtttaatattcatgcaattctgacaagattaatatactaatttctctgtcattagtttcattaacagatattaattatatctgaatctaaatgccaaatgaatagacagttgggattcaattctatttaagataatcgaagttctctttacaatcatgattggggtggcatacataccatctattctggttagagatggactctggacgctagataaaacacttgggattaaaacacttatcctagaacttatcattataggcacttcacataatgggggaaactgaatatttacaataaccttttggaatagttgatgatgatgatgatgggaaagagagagagaaaggccaggtgtggtggctcatgcctgtaatctcagcactttgggaggctgaggcaggtggatcatgaggtcaggagttcaacaccaacctggccaacatagtgaaaccccatctctaccaaaaacacaaaaattagccaggcatggtggagtgtctgtagtctcagctacttgggaggctgaggcaggagaatcatttgaacccaggagggagaggttgtggtaagccgagattgtgccactgcactccagcttgggcatcagagtgagactccatctctaaataaatacataaataagagagagagagaggagagagaaacatccttttttctggtaaaatttagagactagattgtccaatgaagatggctgaataggaacagctccggtctgcagctcccagtgtgactgacgcagaagatgggtgatttctgcatttccaactgaggtactggttcatctcactggttgaatagtgggtgcagcccacggagggcgagccacagcagggtggggtgtcacctcacccaggaagcacaaggggtcaagggatttccctttcctagccaagggaagatgtgacatactgtacctggaaaaatgggacactcccgcccaaatactgtgcttttcccaaggtcttcgcaactggcagacaaagagattctctcctgtgcctggctcgtcaggtcccacacccacagagccttgcacactgctagtgcagcagtctgagattgaactgcggggcagcagcctggctgggggaggtgcgtctgccattgctgaggcttgagtaggtaaacaaagcagccagggagctcgaactgggcagagcccaccacagctcagcaaggcctactgcctctatagactccacatatttgggcagggcatagctgaacaaaaagcagcaggcaacttctgcagacttaaaaatccctgtctgacgctctgaagagagcagttgttctcccagcatggcatttgggatctgagaactaatagactgcctcctcaagtgggtccctgacccccgtttagcctaactgggagacacctcccagtacgggctgacagacacctcatataggcaggtgcccctctgggatgaagcttccagaggaaggatcaggcagcaatatttgctgttctgcagcctccactggtgatacctaggcaaacagggtctggagtggaactccagcaaactccaacagacctgcagctgagggacctgaatgttagaaataaaactaacaaaggaatagcatcaacatcaacaaagcagaaaggaatagcatcaacatcaacaaaaaggacatttataccaaaaccccatctgtgggtcaccaacatcaaagaccaaaggtagataaaaccacgaagatggggagaaaacagagcagaaaagctgaaaattctaaaaaccagagtgcctcttctcctccaaaggaatgcagctcctcaccagcaacagagcaaagctggatggagaatgactttgatgagttgacagaagtaggcttcagaaggtcagtaataacaaacgtctccaagctaaaggagcaagtttgaacccattgcaaggaagctaaaatccttgaaaaatggttagacgaatgcctaaccagaataaacagtgaagggagaccttaaatgaactgatggagctgaaaaccatggcacaagaactttgtgatgcatacacaagcttcaatggccaattcgatcaagtgaaagaaagggtatcagtgattggagatcaaattaatgaaataaagtgagaagagaaggttagagaaaaaggagtaaaaagaaacaaacaaagcctccaagaaatataggactatgtgaaaagaccaaatctacatttgattggtgtacctgaaagtgatggggagaatggaaccaagttggaaaacactattcaggatattatccaggagaacctccccaaactagcaatgcaggccaacattcaaattcaggaaatacagagaacaccacagacactccttgagaagagcatccccaaggcacaaaattgtcagattcaccaaggttgtaatgaaggaaaaagtgttaagggcagccagagagaaaggtcgagttacccacaaagggaagccaatcagactaacagtgggtctctcagcagaaaccctgcaagccagaacagattgggggccaatattcaacgttcttaaagaaaagaattttcaacccagaatttcatatctagtcaaactaagcttcctaagtgaaggggaaataaaatcctttatggacaagcaaatgctgagatattttgtcaccaccaggcctgccttacaagagcttctgaaggaagcagtaaagatggaaagaaacaaccaataccagccacctcaaaaacatgccaaattgtaaagaccatggatgctatgaagaaactgcatcagttaactggcaaaataaccagcgaacatcataatgacaggatcaaattcacacataaaaatattaacctaaaatgtaaatgggctaaatgtcctaattaaaagatacagactggcaaatcggataaagggtcaagatcaatcagtgtgctgtattcaagagacacatctcacatacaaagacgaatataggctcaaaataaagggatggaggaagatctaccaaacaaatggaaagctaaaaaaagcaggggttgcaatcttagtctctgataaaacagattttaaaccaacaaagatcagaagagacaaagaaggccattacataatggttaaagggatcaattcaacaagaagagctaactatcctaaatatatatgcacctaatacaggaacacccagattcataaagcaagtccttagagacctacaaagagacttagactcccacacaataataatgggagactttaacgcctcactgtcaatattagacagatcaacaagacagaaggttaacaaggatatccaggacttgaactcattcatttgaactcgcacttataaaattgaccacataattggaagtaaagcactcctcagtaaatgtgaaagaacagaaatcacaacaaattgtctctcagaccacagtgcaatcaaactagaactcaggattaagaaactcactcaaaaatgcacaactacaaggaaactgaaaaacctgctcctgaatgactactgggtaaataacaaaatgaaagcagaaataaagatgttctttgaaaccagtgagagaaaagacacaacattccagaatctctgggacacatttaaagcaatgtgtagagggaaatttatagcactaaatgcccacaagagaaagcaggaaagatctaaaatcaataccctaatatcacagctgaaagaactagagaagcaagagcaaacaaattcaaaagctagcagaaggcaagaaataagtaatatcagagcagaactgaaggagatagggacacaaaaaaccctccaaaaatcagtgaatccaggagctggttttttgaaaggaccaacaaaattgatagacctttagaagactaataaagaggaaaagagagaagaatcaaacagacacaataaaaaatgacaaagtggatatcaccacagatcccacagaaacacaaactaccaccagagaatagtataaatacctctatgcaaataaaccggaaaatctagaagaaatgtataaattcctggacacatatgccctcccaagactaaaccaggaagaagttgaatctctgaatagaccaataacaggatctgaaattgaggcaataattaatagcctatcaaccaaaaaaggtccagggccagacggattcacagcctaattataccagaggtacgaagaggacttggaaccattccttctgaaactattccaattaatagaaaaagagggaatcctccctaactcattttacgaggccagcatcatcctgataccaaagcctggcagagacacaacaaaaacagagaattttaaaccaatatccctgatgaacattgatgcaaaaatcctcaataaaatactggcaaaccaaatccagcagcacaagaaaaagcttatccaccacaatcaagctggcttcattcctgggatgcaaggctggttcaacatacacaaataaataaatgtaatccatcacataaacagaaccaatgacaaaaaccacatgattatctcaatagatgcagaaaagaccttcaacaaaattcaatggcccttcatgctaaaaactctcaataaatcaggtattgatgggatgtatctcaaaataataagaggtatttatgacaaacccacagccaatatcatactggatgggcaaaaaatggaagcattccttttgaaaactggaacaagacagggatgtcctctctcaccactccttttcaacatagtgttggaagttctggtcaggcaaatcaggcaagagaaagaaataaaggacattcaattaggaaaagaagaagttaaattgtccctgtttgcagatgacatgattgcatatttagaaagccccattgtctcagcccaaaaattccttaatctgataggcaaattcagcaaagtctcagatacaaaatcaatgtgcaaaaatcacaagcattcctatatgtcaataacagacagagagccaaatcatgagtgaactcccattcacaattgctacaaggagaataaaatacctaggaatccaacatacaagggatgtgagggaccttttcaaggagaactacaaaccactgctcaatgatataaaagacacaaaaatatggaagaaaattccatgctcatagataggaagaatcaatattgtgaaaacggccatactgcccaaggtaatttatagattcaatgccatccccatcaagctaccaatgactttcttcacagaattggaaaaaaactactttaaagttcaagtggaaataaaaaagagcccgcattgccaagacaatcctaagcaaaaaagaacaaagctggaggcatcatgtaacctgacttcaaactataccacaaagctacagtaaccaaaactgcatggtactggtacaaaaacagatatatagaccaatggaacaggaaactgggctcagaaataacaccacacatctgcaaccatctgatctttgacaaacctgacaaaaacaagcaatggggaaacgattccctatttaataaatggtgctaggaaaactggctagccacatgtagaaggctgaaactggatcccttccttacaccttatacaaaaattaattcaagatggattaaagacttaaatgttagacctaaaatcataaaaacctgagaggaaaacctaggcaataccattcaggacataggcataggcaaacacttcatgactaagacaccaaaagcaatggcactaaaagccaaaatagacaaatgggattgaattaaactaaagagcttctgcacagcaaaagaaactaccatcagagtgaacaggcaacctacagaatgggagacaatttttgcaatctacccatctgacaaagggctaatatccagaatctacaaagaactcaaacaaatttacaagacaaaaacaaaaaaacccattaaaaagtggtcaaaggctatgaacagattcttctcaaaagaagacatttatgcagccaacagacacatgaaaaaatgctcatcatcactggtcaccagagaaatgcaaatcaaaaccacaatgagataccatctcacaccagttagaatgacaatcattaaaaagtcgggaaacaacagatgctggagaggatatgaagaaataggcacacttttacactgttggtgggagtttaaattatttcaaccagtgtggaagacattgtggcgatttcttaaggatctaggactagaaataccatttgacccagcaatcccattactggatatatacccaaaggattataaatcatgctactataaagacacatgcacacgtatgtttattgcagcactattcacagtagcaaagacttggaaccaacccaaatgtccaacaatgatagactggataaagaaaatatggcacatatacaccatggaatactgtgcagccataaaaaaggatgagttaatgttctttgcagggacatggatgaagctggaaaccattattctcagcaaattatcacaaggacagaaatccaaacaccacatgttctcatagttgggaatcgaacaatgagaacacttggacacatggcagggaacatcacacactggggcctgtcagagggtggggggctggggaagggatagcattgggagaattacctaatgtaaatgacgagttaatgggtgcagcaaacaaacatgccacgtgtatacctatgtattcaatctgcacgttgtacacatgtaccctagaacttaaagtataaaaacagaaattagagacattttctgcctcaaatagatataacgcatgttactaatttattaagcagaactcatcaagatgccaaaagataaaaatctactaaatcaatgatatagttaccaaaagtcaccctgtataattcatggatttaggacatgattaagtacatacttagcataattgaaaggtgtccacctgaaagcaacagtaatcacacacacacagacacacacatgagtcaatctgtcaaaattacacaccaagcttttaattaattcatcaattatacatcagtgtttctggattattagaattattttgacacattaaaaagtaaacactcctaatttaactcatattatttttgataaaggcattgtggtatgccatcatttcataatatacactgaaacatattcaaataaaatgaaactatatctgagacatgcttcaagtaatttgggaagaaaggatgggagaagatatagttggtgcaagtatgcctatgaattggtaattgttgaaactgggtgataaattcatagtgtggtcatgatggtcttctgtttttttgtatatatttgaaaattgctatataaacatttttgaaatacaaattcttaggccacattccagtcatattgaattagaataccctggagttgaagcttcaagtgagaggtgaagccagctgagcttctgggccggatggggatttggagaacttttgtgtctagctaaaggattgtaaatgcaccaatcagcactctgtaaaatcacaccaatcagcatgctgcaaaatggaccaataagtgctctgtaaaatggaccaatcaattctctgtaaaatggaccaatcagcactctgtaaaatgggccaatcagcaggatgtgggcggggccaaataagggaataaaagctggccaccagagccagcagcgtcaacctgctcggatccccttccatgctgtggaagttttgttctttggctctttgcaataaatcttgctggtgctcactcttagggtccacaccacctttaagagctgtaacactcactgagaaggttcatggcttcactcctgaagtcagtgagactacaaacccactggaaagaagaaactctggacgtatctgaacatccaaatgaagaaactccggacataccatctttaagacctgtaacattcactgtgaagctccgcgcttcattcttgaagtcagcaagaccaagaacccagtggaaggaacaaattccagacacatttggcaaccacgaagggataatcaccaagtagtgagtaccatcggacccctttcacttgcaattctgttctatttttccttagaattcaggatctaattatcgggcacctgtcggtcagttaaaagtggttggtggccgggcgcggtggctcacgcctgtaatcccagcactttgggaggccgaggcgggcggatcacgaggtcaggagatcgagaccatcccggctaaaatggtgaaaccccgtctctactaaaaaatacaaaaaattagccgggcgtagtggcgggcgcctgtggtcccagctacttgggaggctgaggcaggagaatggcgtgaacccgggaggcggagcttgcagggagccgagatcccgccactgcactccagcctgggcgacagagcgagactccgtctcaaaaaaaaaaaaaaaaaaaaaaaaagtggttggcacggccactggaataaaaacacgggtgtcaggcattctaggaaagggctctcttacaacccctgactcttcggggttggaagcattgatttgcctggaaccagcttccacttttcttgtacttctgggctgagccgagggtagacagagtggaaagccattcagctccagggtcccaacaacaagttggttgaccctgaggctgagcggaactctcaaagacatgtcgcctaagggagactcgcccatctctcctatctatcctgacccttgcctcctgggtcctcatgcctgtcagacaaacttcctcttgcctctcttctctgaggctagtctcgcttctaaaaaccactccctgtctctggtgcttttctagtttctcgtataagaatgatttctagcataaactttaggactctattcccttctttaggcacccaggctcaccaatcagaaagacataatttttgcccaaagccccatcggaggagccagactatcttatctggaattttaggacccctcctcaggctagcaggcctaacaaaggctattcctgaagctaggatatggggagcctcagaaattgtatccttgctattcatataagtgaggacaaaaggcatcactcttccaaccctggagatctcttccctctctcagggtatggccctccacttcatttttggggcataacatctttatagggcatggataaagtcccaatattaacaggagaatgcttaggactctaacaggttttctagaatgcattggtaagggccaataatccgaccttcctcattcctccttgtggtctaggaggaaaactagtgtttctgctgctgtgttggtgagcgcaactattcccatcagcagggtccagggactgttgtgggtgcttgggcaagaggggtttctgctgccacgtcagtgagtgtaactattctgatcagcagggtccaggggccactgtgggttcttgggcagggggagaaacaaacaaaacaaaaccgcaggtggttttgtctttcagatgggaaacactcaggcatcaatgggctcacccttgaaatgcatcctaagccattgggaccaatttgacccgcaaaccctgaaagaaaggcagctcatttttttctgcactatggctcggccacaatattatctctctgttggggaaaaatggccacccgagggaagtataagttacaatactatcctgcagcttgactttttctgtaagagggaaggcaaatggagtgaaataccttatgtccaagctttcttttcattgaaggagaatccacaactatgcaaagcttgcaatttacatcccacaggaggacctctcagcttacctccatatcctagcctccctatagctccccttcctgttagtgataaacctcctctaatctcccttgcccagagggaaataagaaaagaaatatccaaaggaccacaaaatcccccaggctattggttctgtcccctttaagtagggggaggggaatttggcccaacgtgggtacatgtccccttctccctctccgatttaaagcagatcaaggcagacctggggaacttttcagatgatcctgataggtatataggtgtcctacagggtctagggcaagcctttgatcttattggaaagatgtcatgctattgttagatcaaaccctggcctttaatgaaaagaatgtggctttagctgcagcctgagagtttggagatacctgatagcttaatcaagtaaatgatagaatgacagctgaagaaagggacaaattccctactggtcagcaagccgtgcccagtatggatccccactgggacttcaactcagatcctggggactggagttgtaaacatctgttgacctgtgttctagaaggactaaggagaattaggaaaaagcccatgaattattcaatgatgtccaccataactcatggaaaggaagaaaatcctgccttcctcgagcagctatgggaggccttaaggaaatacactccactgtcaactgactcactagagggtctattgatcctaaaagataagtttattacccgatcagccacagatatcaaaagaaagctccaaaagtgagccctaggccctgaataaaatctggaggcattattaaacctggcaaccttggtgttctataatagggaccaagaggaaccggcccaaaaggaaaagcgagatcagagaaagactgcagccttagtcatggccctcagacaaacctaccttgctggttcagagaggacagaaaatggagcaggccaatcacccagtggggcttgttaccagtgtggcttgcaaggacaccttaaaaaaggttgtccaatgagaaacaagctgccccctcatccatgtccactgtgcagaggcaatcactggaaggcacactgccccagagggcaaaggttctctgggccagaagcccccaaccagatgatccaacaacaggactgagggtgcctggggcaagtgccagctcatgtcatcaccctcactgaaccccaggtacgtttaactattgatgaccaggaaattgacttcctcctggacactggcatagccttctcagtgttaatctcctgtcccagatgactgtcctcaaggtccgttaccatccaaggaatcctgggagagcctgtaaccaggtatttctcccacctcctctgttgtaattggaagactttgctacagatagtaagtatgcttatctaatcctacatgcccatgctgcaatatggaaagaaagggagttcctaacctctgggggaacccccattaaataccacaaggaaatcatgcagttattgcatgcagtgcaaaaacccaaggaagtggcagtcttatactgccgaagccatcaaaaaggggaaggagaggggagaacagcagcataagctgctgacagaggcagggaaagaccagcagaaaggaaagagagaaagagacagaaagtcagagaaagaggaagaaacagagagacaaagaggaggagacagagagaggaagagacagagacaaagaagaagtcaaagagtgagagagaggaagagacagagagacagagagtcaaagaagtaaagagaggaagagacaaagagggagtcagaaagagaaagacagacaaagaagagagagacagacaagaagtcaaagagagagaaagagggagatagaagtagtaaagaaaaaacagtgtaccctattcctttaaaagccagggtaaatttaaaatgtataattgataattaagggtcttctctgtaaccctataacactccaataccaccttgttgtcagtgtaaacaagggtgtagcccaaaagcactgaggctactgacaacccatagccttcctatcaaaaatccttaacccagcaggtttccaaacagggatctaaatcttaatgaattaccatacaaaggtctgaccagatctaggaggaactcccttcaggacaggaggatagatggttcctcccaggcagttaagggaaaaagacacaatgggtgttcagcaagtgataaggaaactcttgtagaagcagagttaggaaaatttcccagtgattggtctgctcaaacgtgcgagttgtttgcactcagccaaatcttaaagtacttacagaatcaggaaggagctatctataccaattctaagttaatatggactgaacgaggttttcattaatagtaaagaaaaattataatcccaaacttacaaggctttcaactaaagtttgctaaaagttaacagtgtaatatgtattatcctgctaccacacactcttaaaggaattctcagacagtttgcaagaaataacgaaatctatccttactctacaatccgaagtagactctttggcagcagagactctcctaaactgctgaggcctagacctcctcactactgagaaaggaggactctgcaccttcttaggggaagagtgttgtttttaccctaaccagtcagggatagtaagagatgctgccaggcatttacaggaaaaggcttctgaaatcaaacaatgcctttcaaactcttataccaacctctggagttgggtgacatggcttctccactttctaggtccggtagcagccattttgcaattactcacctttgggccctgtatttttaacctccttgtcaaatttgtttcctctaggatcaaggccatcaagctatagatagtcttacaaatggaaccccaaatgaactcaactaacaacttctaccgaggatccctggactgacccactggccctttcactggccgaaagagttcccctctggaggacactacagctgcagggccccttcttcgcccctatccggcaggaagtagctagagtggtcatcgcccaattcctaacagaagttggggtgtcctgtttagaggagggattgagaggtgaagccagctgagcttctgggtcggatgggggcttggagaacttttgtgtctagctaaaggattgtaaattcaccaatcagcgctctgtgtctagctaaaggattgtaaacacaccaatcagcacttggtaaaatcgcaccaatcagcactctgtgtctagctaaaggattgtaaatgcactaatcagcgctctgtaaaatggaccaatcagcaggatgtggatggggccaaataagggaataaaagctggccacctgagctggcagcggcaacctgtttgggtccccttgcacactgtggaagctctgttttttcactcctcacaataaatcttgctgctgctcactctttgggtctgtaccacctttaagagctgtaacactcactgagaaggtatgtggcttcactcctgaagtcagcgagaccacgaacccaccggaaggaagaaactgcagacacatctgaacatccaaaggaagaaactccagacagaccatctttaagagctgtaacactcactgtgaaggtctgtggcttcattcttgaagtcagtgaaaccaagaacccactggaaggaacaaattctggacacacaagttcctaggcttcatccaaaacattaaatcagactctttgaggtagagtaagacacatatttacaagctagttatgcaagttatgatccaggtaaaacactaatcgattgtatccaaaatataagtcttctatcattctgttgtacaaaatgaatgaaatctctaaaatatttctttaggaaccaacacaaagatattccattgtactaagtttgttttctggaaaacaaactctcaggtaaatttgcatgtatgatgtttataagggaattaacttttaattaattatgagaggggagttgaaaagaagtacaatccaggcagagacaacaagcccacagaatatcttaaaaggaatggcttcctgagttctcatgcactgaggctagatgactgggccttgatataactctctccagccccactgaccagccatttgatactatgcttccaggtgatgaatttgtgtgaaatggttgtctttaaatgaagggcaattcctcaggagagactcaagtaattttcactagccagcaacattcctagcatgtggggatgaaggtaattgagaggggagaattcattgcctcaatggttacacatgtaacacttcatagcacccaccacatctataagagctaatatattttttctgggaatttctttactgtcttttctcatttatctttatatatcccttacaagtcaacaaagaaatactgcagtggtggttatagtgactacactgtggttgctggctgtttttttagtgtttaaattaaataatattacccttaggaataaaatgtaaaaccatttttttaaaattcccatcaaaatcaacataacatactgtttgtgttagtaacagaaatatatttaactgcatagataataatgaatagcagtctggattttcaaataaattatttcaagatgatatttactaggttagatacatgtaccctaactcccacccattcacttcctagaaatgtgttttaggtgatgttatttaggtggtaaaatcaggtcaataactcctactgaatccttagatattatgtgttgtacagggaaaaggtagtataggtaaaacttgtgtgagacacactttgttgttttagactagactgtaagttccagctgtgtctgaatgtttgtgtttccccaaaatacatatgctgaaatcctaaccctcaagatggcggtattagaaggttgggaggtgattaggtcatgaggggtgttaacaatagttcccttaataaatgaaaggcctaagagagacccgtcgcacattccactatttgaggacaccactaactgtgagccaaaagcaggacctcctcagacatcgaatctactggtgcctttatcttagaatgccaacctccagaactgtcagaaataaatttttagttttataaatgcctagtttgtggtattttttatggcagtcgatcagactaaaacaaatgtttactctgttgtgatcagatagtttatataacttacctaacacataataggtactctagtaggtcgctcctcctttgacctcagacctttccatttgagaaattttacaactttatttcaaaatgcattccatctactttacaaagtaaaaatacaaaggcctcttatcatgatgtgactattaggctttacaagcctatatcaaagtgtttcatgtaccccataaatatatacacccacacatattaaaaatttaaaaagtgaatgttatacacctccccacttcctttacaaaacttagctcaattccatctggataataagaaaaataggaaactttattgaataatgagtcacttctatgtgtaatttccactgctagtatgagccttcagaagggactggctttaagaattggtacagttcttgactgagaggaacttccaccacctagcagatggggcaatagattacaagggcaattatcactcagagaattgctgataaggtcaaattactgctgtcactttattcttaatctctgtatgcatttttttttctaaaagaaaactgcatatacaattctacagaccaaaaatattgcaaaaaatatgagtttatatgtcctaagagggttccccaattatcacaattgtttcaaatggaaacaatttcatatcccatatgtacatatatataaaaatatatttatgtatgtgtatatatatgcatatatatgcacacacatacacatttctctgcagatgttagtatgtggaaatgtattgctatataatagggacaataattagaactcaaaatctagagtaatgcaactgaaagtcatatcatgcatgtattacaagtaagatactctgcaatgtatacaagagaatgtaatttttaaggaccaaatgtgtgttattaatcaggtatacactctgtaaacactacgtggtataaaattgcttctcaacacaggaaatatttataacctaagtatacagtccaagaagtactttatttctgacacttcataccaaagcaaccagactgacaaataagcattctgagtaaaagcagtgttttaaataacttttgaacccaatgcatgcatgcaaggctgataaatgcaaacccttttacataatactcaaatcatattaaagagatgcttcttgacagagatacacttaaaccattctacatttctcctttttgttctcctgtgtgaaaatgtcaccttaaaagcaattttttaagaaacaagtgctgtttcatttcatgtcttcagatacattgtctgcccatgttttagcgattaggaatttagaggtttttggatgtttattacaactctttgacttatcagtataaatatttatcataccaatcatatttattctttgattatcttgacatggcaaggttttttcaattttatttaaaagagccagctgttttgtatcttatttactcacccatatcattgtttcccgttaaattaacactggcataagccagctgcaagttgcaaggaaatcgcactgaaaacagagctactataaattgtattcgcctctatataccaacaaaaacaaataaaacttttttattaatctctatgactttgttgttgtttaaagcaaatctacattaggaagagttgtcaggaaatttgggaagttatattgtttcctgaaacctgatattgattgatgagagtataccaatgattgcaagttctgagaaaagagttttacacaaaatgaacagcaaaagcttgggcatgagaacaaacttagaatgtccaagggataggaaaaaacgtcctggcagcagagcagcagataggcaggaattgaatcatgtgtactttggtaagccatacacgggcattgagaattttattcttaccacagttggaagtcactggaatattttaagcaagagagtaacttgaactgatttatgcttttaaaagattaccctgattggctgtgtgaaaaataagcgatagggagcaaaagtagaaacagggacaggagatgacagtggcttatgtataagatttcttctaaggatcttgaaagcatcatgaactaacatcacttgggaagtagataaattcattgctgtgtccatagtctgtttatttccctttttttttgtatgtatttgcagaatatgttagtaaacaaagtgaaattcaaggaaatcactattagggctgcctacaaatcaagtcggtttagagctattatagttgagtagtaatattctttcagaaaaaatcttaatcataaagcccaacacttatactatggcttcttaaaagtgaagctgcaaaactgcttgtgaacaatcttacagctatttttataactttttaaagtgttatgtacataatttcttttctgatgacctcattgaattctaaaccatcttttagccacacataagccccaacagttaaaactattaaaatgcattagcatgtccttcattatttgttttaatcaagaagaactgaaataaggaatatgtaacataaatttagttttgctaacgaatacatcagagagaaatatatctccttagagaggaatatattttatctaggtattttttttgaacagtgaagcactttttaaaaaagtaatactgtacacagaattccaaaatataaaacagacaaataaattaaggtacctttatacaaagtcattctatgcagctattataaaaagtaaaatatatatgcattgatagggaagttttaatttattccatataagtaaatattaattgagcattttatatttgagccatcatcctaacagtttgtgataagatagcaaatgatatagggaaagtctctgttttcagatgtttttatattttgaaggaagtagacaaatattaatcaattaagtgaatatgcaagaaatttccacatagtaaactaatctgcagaaaacaaagtcatgaattatctaattcttgagggaacctattacagactgtgttattagggaagccttttttaaggaggcatatatgagggaaaatctaaataactaaaggagccagccataggaaaatagcagaagagaatattctggaaaaaaaaaatggcacacaaagacatttcacctcagccaaagaatatgggatgataaaggacagaaaaaagaccaggaagcaggaggaagagaggtagtagaagcagatgggatgaggcaaatgagacaagatagtgtaggaccttacaggtcatggtagaggaagacacttagatatgattacttaataagaagctatcatagcactgaagcatggaagagatgtgatctaatgtctatttttcaatgccattctgaccagatttcgggcaaacctggtagacacccatagtaagactccaggaaaaaaaaaatttgatggtttgattatatatttgctttaaacatttggcttttcagctgccttgcatccatttccctttaacaatttatctgtttttaaattaatgaccttttctattagacacactttcatcaggggccctgtattgattggtatcttccagagaaacagaaccaataaaatgtgtgcgtatgtatgtatatgtgtatgtttctcagagagagagagcgagagaaagataatttaaggaactggctcatgtgattgtggagttgggcaagttcaaaatctgtaggacaggccagcaggctggagacatagggaggaattgtcatagtttgtgtccaaaaatagtttgccagaatcctcagttttttgagggaggtcagtctttttacttaaagccttcaactgactggatgcagccaaccgatatcatagatccaaagtccagtgatttaatgttaatatcatctgaaagcataccttcacatcaatatctagatatatttgacagatatctgggtaccatgtcttagccaagttaatgcataaaattaactatcccaggctccattccctctggtcaaagggcaagcatgtgattcaagctaggtcaatcagttgctctctccctcaaatttgcactgggttaaaaagacaaagaattacatcctgtctatacagtcatgccaaatcacatgatccatctccaacccctaaaacacataggtatggcttttgttctcaaccttcagctcctaattcctttaaaaagttaccagtatattctgtgaggccacagtgaatcttctaatagtttacttttatgtaggccagagtcatttggcttgtttgaaattaaatatatatatatatacatatatatatatatgtgtgtgtgtgtatatatatatatatatatatatatatatatatatatatacatatatatatatgtgtgtgtgtgtatatatatatatatatatatatatatatatatatatatatatataaaattgcttcagtcaggctccaggtacttggaaagacattcatcaaattaataatggttatcctggggactgggctttgaggattgaggatttctgatttttaatatgtgtctaatctttttaaatgtttcagtataatttataattagcagccaattattttataattaaagtaaatcctgaaaaactttctacattagtgtgtggaaaaacagcacaattgccaaatttatagggcgaagaagtcctatgtttacctagaggggaaactctgaaccaccacagcccaacaggaggctctgtgggacaatttggaaaacattaccataatctattgtttttatatttatttagaaaagaaacaaagggagcaagatacctccccgtctgacatttaaaatttgattcactgatatattttggctcacagtatcaccttgtggcatttggcatctgctgctccccctccccaaagtcataatatactgcataattaattcagcacaagtagtgacaatgccaactctgtttatttaaaaagatacctcgactgttcttttgaataaatagattgcattcctttaaaaatccaaaataatactgaattaattagaagtagtgcaatcagaataaattaggtcctatctacatacaactcagttttaaagctagaaattcaaattaataactaatttgaattagctacttcttcccatgtgtctctgagtaaacaccaagcagacgaaaaatttccattgccaataataatagtaacaatagcaaatattgttaaactcttactatttgctggtaactagttaagcatgcttcataaatcttcttttatagtagtcatgaaaaccacatatctgagctattaccttcattttgtggatgacaagttcaaactgagttttagagacagtaagcaacatacccaacatcacacaagatttaaattcagactctgagtgcttacaaactatcttacgctgtgatggtaaacatctttgcaaattttccctcataattgagtaagccatcagagtttcagaataaatgtgtaggaaaacttataaacatcagggacaagcttaaggacttgacatcttttacttttgtgtgtgtttcatagaaaaaaatagctcaaaggttaatttaaagtaatactttgaacaaactccttaacaagaagagttagacttcatacttgttattcagcagaatagtgactttgttcatacaactaaactaacgaactcaattcctcctttcgactgtttcttttttttgcctccttaatagttattttatacctgtttcttattatttatttattccactaaaaatttcaatgtcttcacattatctataattggtgctatggtatattacagttgaatatagttgaacctgttcaaatacattttgaccaatgataaggagaaccaaggattcctttgctttcatattacttcacacatgactttttaaaaaatttactttaatttctgggttacatgtgcagaacgtgcaggtttgtaacataggtatacacatgccatggtggtttgctgcacccatcaacccataatctacattaggtatttctcctaatgctatccctcccctattccccgacccccagacaggcccccatgtcacacaccacttttagaatcacaatacaatttcacattcaggacaatacttgctgaattttagtttgtgtttgtgtgcgattgttgatgggaagaacaaaatggcagtcacatcatatgttgactctagatgtgttatttatcatttgtttcttcaaaatattttgacaaacgatcttcgcattaaaaggctgtgggcagtttgggagctaccacctgtttccctcttcattgatcactttgctggccccaaaacatatccacagaaaaaattttgaaagtgattggccaagggactcagtgaggatatactttaatatttagaacactattaaaaacaaaaggagacattattaacaatatgctgggacaagaattataacctgggactttctatggcaaatgggatatatgattacttgatctagactgtataaaataaataatatatttggataatctacaattacaataagtatttatacacacaaacatatatatacgtacatacacacacacacacacacacacacacacacacacacttcacatatgtacctttacaaccaatatactttaattgagactgagaggacaagagccatgattattcatatttatattcaatgacttattacataataaacatattttgaaaatttgatgagttaattcaattcaaaatatgcaaaaaatatcaggctgggcacggtggctcatgcctataatcccagaactttgggaggccaaggcaggtagatcatctgaggtcaggagttcgagatcagcctgaccaacatggtgaaaccctgtctcaactgaaaaaatacaaaaattagccgggtgtggtggcacatgctggtagtctcagctacttgggaggctgagagaggagaatcacttgaacacaggaggcataggttgcagtgagccaagattgtgtcactgcactgccttggtgacaaagtaagactccatctcaaaaaaagaaaaaaaaaatactgtatatctgctatgtgaagccaatgggtttcaagttaggatataatgacaaagaagtttaaagaattcatagcgtagtgaaagaaaaacattcatagtaaatgaacacactgtaatgaagagtttaatatttatagtaggaataaatgggatcacaaagagaaactattagttttgaggatctatcattttaggttaactgatatgaaccttcaataacaaatatgtgcttaacatatgaaacagagagaaagtagggtaattctcagagttgttcagggtcatatgtgatgttctgtgtgcctagacaagttgtactatgtgtgttagaagagatgagactggaaagtggtcagatataagttactttgaatgataagataaaagccgtggaattcatttggtgtatgatggaaaacactgaacctttttaaacaccaaaaaatcagatcagcattgtattgaaaaacaaaaacaaaaacaactttggctttattgtgatggtggttagaggagtgagagactggaggccggatgccgagtttagagtatgtctttaaatagatgttctgacagtgtaaatagacaggtgtcaaacagatttgagtaagagtatataggtaatgcagaaaatggctttggagattgattgagtttggaacggaggtcattgaagtctaggttcaaatcaataatgaccacaggagtaacaatacatagtaagtatggatacattagaattggatagaaagaataatgaggcatctgccagaaacacagttaaaaatatccagaaaaagacgagaaattcaaacttggaactcaagacagatttcaagttagaagacttatctacaacaaatacataatccctatttgaggaaaaatagaactctatataggtttgctcaactcaatcttagtaaaacaataagggagaaaaaaagaattacaaaagagagaagccttggaactctttaaaatttaatcataattttaaaataaatttcaaaataaataaaagtgatcaaagatttaagaggcaaaatccaaggccaccaagggaatgagaaaaaacggtacttccataaaaaagcaagagaggagagatttcccagactgtaatatatttaatgtgaggctatgccaagaagaaatgataagtgttgtagatcactgaaaatcatcattacttttctgataactgagaaagcttccccggagggagagggtttcatagataaaccagagaagctgtttttgacatgaaagctagattttttaagacaaagattgaagttgagatgtttgtcactagaaattattgggatccaatccaatggttttaaacagggggagagaaaaagatgaccatgttcagtgagcaactgatgttgaaatactgaaaaccacatggtgcaataattaaaggaaggtatacacagtaaacgcatagaaaatacgttaatatatcattcatttttctgtccagggataaataacactgcaaaagaaaaaacagccaaccaatcaagcaaacacataaatgtatgctactgttcaattgaaaaaaatgcataaggatttatcatggttttatctgtgcttcattagaaaataaagccaaggattttatactccaaattctacagacttttttcataataccagaaaaccttaactttacagacataataactttaaaagagttggaaattaagaataaacatacataataatatatctgggcaataatttatttcatcctacttgcctagcatcctcaacgtagtttggcatacattaaggtcctatagaaatttatcaaattaatactaaattagcagagtactatgaattgctttctacctttgtaacaccagatgtatatatttatgtgttcaatataatattaatcttagtgtttgtgaaaacattaatttgccaaagagagttgtttatattagaaaaccgtgtaatctacatttataaaatcagtgtatttctaaacaagtgactttaaattttgatataaagcgatttttatttttattatatcatagttcatgagataaatttattaatagactatatttttaaaagtttttctgaactgacaaattctgcatgtattataatggggttaggaatggtttctcaagtcaagaataccaccaaagtaaggaaaatttcacatcaacataggtgaacaggtggcaagtcttccaaaatttgaagaattctttcaagaaaggatcagcaagtatgtaattagagtcaacatgttctgtttagctgacattaatggttagctttcactctggagagcaagatcttattgaaatttcatgaaattttagcagaatatataaaggaaaatagaaaaagagacaatcaaaaagaataaaagtacagacataaacacagtaatttgaatgtgaagctcaaaaactaactccagtttttatacctagtgttctagaatggattcaaaataacaatatacataacaatgtacataaaaacctgatgccagtactaaggatgattttattttctaaagattgccacaataacattttcttttccatatgctcttcttataatgtgacttggacacccctcatatagggaggtggagtatgtttctaccccttgaaactggcagagatttgactacaacagaactgacccttcaaattccatagctaatttatgaaaatttctgcctaattctcttgggaagcttgttgtgacaacccactgtcttgctgtgaggaagccccaacagcctataagaggcttcagtggggtgaaaatgaagcctcagtcttcaatcctggatgagcaccagccaacagccaaaatcaacttggtagccatctaagttaatcattatgaaagtggcacccagccctcagttaaagtgccacagctgatgctgcatggagcaaagataagatgttttctcaagtcttgctaaaattgcagcttagtgagcaaattaaatgattgtagtttgagcccactaagttttggtggcctgttatacggtgactgataatctgaccaagtgcctaggcttacaagtaaatatatctatatttttgtacatgaaataaaaaaataaatatttgccataattacttaaatgtataaatcttaaattctcattttttcaaagtatgttaaggaatggctcaatctgttaaaaatgataaaaggatcaagattgatcattccagaatttcttccataatatttaattcaaaaagcaaggttttaaaagaaaataaaagagtaattgttcaaaaaaatatttattgatcttcagttaaagacctcctttttttactggcaagaatccactatccttaggatctttcatgctctttgcccaaacactactttacaaaggattcagagcataaaaaatttcctgacttatttcttcaccattagttcattattctccttatgttaggatatgcaatatttaatattggactgggtttgtcatctgaagactgaataagttttatccttggactagttctactttgagtactgatactcaaaatatgaatattatagtacaacaagggagatagtgaggcattctgaccaaaaatttgcccatactctctgaaaatacttttggatataaatatttttcaacaactatgtccacctacagagtgaatctccaacttaacccaggctgccagagccagaaaaaacctgctatcaatttttgcatgtagagctaggactcaaatgtatcttaattttatttactcttcctaaattgtatctatatacttaaactgtctaccagaaacgtttttgtgtatattcaacacatgcaaccagttaatatttgtgcagagcttagcatagttcattacgaacagaacattctatacaacctctagacattatgatcacttacgttattaccccaaattgaaagtataatctggtctctagcattaaactgcataggaatgagagagatgctcagtctgtaatctggagaggaaaggaaggtcaatgattctttgtaaaattaagtttgtacactctgcttttcaagcagcagtctctatcttcctttactttcctcaatgaactaactactagtaaacagtcatcagactgactcattgaattggattattgcggtttcaatgtataccttctcttggggtcccactggtacactagctgaatctattaactcggaaacataaattaatactaaaaatatatttttctttttccttttttatatttaaaaggattttaattggaagtacacacacacacacacacacacacacacacacacgcaatacagagtgccaaatttgtatggggatgattgaaaaagattattatcaagtattaaatatttgtttcagcatatttgttttttcactgttgtctttccgaatagaaattttcgaatgaaacaaaaatgcacattttaataccagcccaatatacttgatccttacatgtttaaatttcatgtgcaaaaaatgattagtcatagagcaaacccaccctcttgtagaaattttaaaagattttaatgccagcgtaatatacttgaaccttacatgcttaaatttcatgcacaaacaatgattagtcatggagcaaacccaccctcttgtagatattttaaaagataaataaaaatgaaacttttttaaaaaaagagttatattttaggttcaggggtccatatgcaggtttgttacataggtgaagtcgtgtcatgggaggttgttgtatagattattgcgtcacccagttagtaagcccagtacccaatagtcatcttttctgctcctctgtctcctcctaccttccaacctcaaatagacttcagggtctgttgttctcttccttctgttcatgagttctcatcatttacctcccacttatatgtgagaatatgcggtatttggttttctgttcctgtgttagtttgctaaggaaattagcctcccactccatctatgttcccgcaaaagacaagacctcattattttttatagctgtatagtattccatgtggtatatgtacatcattttctttatccaatctgtcattcatgggcatttagattgactccatgtctttgctattgtgaatagtgctgccatgaacattcatgtgcatgtgtctttatggcagaatgatttatattcctctgggtatattcccagtaataggactgctggatcaaatgggagttcttcttttagctctttgagaaattgccacatggctttccacatggttgaactaatttatactcccaccaacagtgtataagtgttcccttttctctgcaaccttgccagcatctgttattttttgactttttaataatagtcattttgactgactgtgcaatggtttctcattgtggttttgatttgcatttctctaacgattagtgacatttaactgtttttcatttttttattggccacatgtatgtattcttttgaaaagtgttcatgtccaaaagaaaacactttttgatgtttttatttaattcttgtaattttaaattcctcatagatgctggatattagacctctgtcagatgcatagtttgcaaatattttctcccgttctgtaggtggtctgttcactctgttgatagtttattaagctgtgcagaagctcttaagtttaattagatcccatttgtcaatgtttgcttttgttgcaattgctgttggttctttgttacaaaatctttgcctgtgcctttgtcctgaatagtattgcctaggtggtcctccagggtttttctagtttggagttttacatttaagtctttaatccatcttgagttgatttttggttatggtataaggaggggggggtccagcttcaatcttcatatggctagccagttctcccagcaccatttactgaataggaagtctttttgccactacttttgtcagctttgtcgaagggcagatggcagtaggtgtgcagccttataaaaattatgtttgtcatcattacttttaccagtcctttcaagtaaaatttttatgttcaccatctttaatagtttgtgtgttttttttgtttgtttgtttgtttttgtttttgttttttgggttttgtttttttttttggctgggattcaacaaaataacataatggcatataactttaggtattctacatctattttgtccagtcaagttctgattagcttttttgcctgcaaaaatacttcatttggctgaaaacatatttttatccaatgcacataactatttatttttctctccagctgttttttttattcatgcaagttaactggaccagtgatcattgctgtgagtagactcaaaagtgattctcagctattttagatctgctgtgagaaaaaccaatagatgtattaatattataacattggataagcactctggctttacatttaggaggcattcctgttctattcctcaaaatctcaaatagaggaccctcagaacttcagttctcatgtattttgaggaaaaaaagtcaagtagcttccaacaaattctaacactttgagccattttgggaacccagagagctgattgctttccagggaaatagcaaaaatactggttaaatggttaaatcctagaccacggaatttttaaaaacagaatatgtgtatacacacacacacacacacacacacacacacacacacacacacacacaaatacaccttttaggggagaaattgatatttttgcctcagcaggatatccatttgccttaaaattcttattcttaggtatgtacatcaatcatctggggaggtccaagctgtgaaatccaaactgacagaaatttatagctccattagcatttatcaaaaatacaggattaagtgtagaaaatatgtattcatgcttcacctttctatatctttactttaagaggtaagtatttgtattcagtatttgttagctcctaccttcaaacggccaaacataatctccaataacatttcagaattctactgggccaaaaatgtatcctattgacctgtgtgtcctctgacttacgactgcatgtttaaatatgaatttaagaaaatgctgcactgattatttggagtttttcagaatggctagtgaattccttggtgatttattggtaaaaaaataaaataaaataaccatgttggactgttgtttcataacatactttctatttggaaattatataattactctttgtgttaaaaatgtattcatactccctgaaaatagtttcggacataaatatttttcaatgtgcatatactgagttttgctattataaattatatgtctacaaaatacttgaacatgatcccattgggttttaaaacatgcaaataaatggagaaagataagagtatatttaccggagttctcaactcaggtatggcagcttgataagtgagtggacggcaatcacgagtgtttggcacaaggacacaaggaagaaacattggacccaagtcatctccatccagaacatccactgtgagagtggtggtggtggttcgcctctcattcagattttgggcacggtcctgttagggagaaaaacaaacaacaggtagtttatagaaattaggcacaatagccaggagcagtggcccatacctgtaatcccagaactttgggaggccaaggtgggtggatcacttgaggtcaggggtttgataccagcctggcaaacatggtgaaaccccgtctccactaaaaatacaaaaatctgggtgtggtggcaggagcctgtagtcccagctacttgagaggctgaggcaggaggatcgcttgaacttgggaagcagaagttgcagtgagccaagatcacgccactgcactccagcctgggcgacagagtgagactcagtctcaaaaaacaacaacaaaaaagaaattaggcacaatgtagacttagttttcattgaaaaaaaaaagattggtaaattaacttgcttaaaccaacagttttaagtggttgagtcaggatgtaaactgagatccaattgtcttcaaagcaactttcttgaaagtatgttacagtagttaagcttttgtatgttaggcctttacctaacagttcacattactagacagcctaaccataaaggtcactctcatctcattagagcatttactttagaaaccttgtaattgtaaattccttctctgcgcctctgaggtgttaatcttttataagctgcttgtcagttctacaaaccaggcccatctttttcatgccctggggggccatctctttgaaatgtaatagtcaaggaagaagcccgtatttcccagtttctgtgggaggttaggagcctgacttcctttggaggcttgctccaatttctaaaactactttctgtcatgaaaattcaaggaaatttattttcctttgggaatgccaattagtaaacacatctggtctgtgattcccccacacccaagtccactggagtgtttaacagctctccagccattttttctattagagatcagttcagatctagtctgtattctggtctctcttctctattgcaatagctgtgaatacagtcttccttatcatttaactttgtctagtgcaattttgctgtaggaatacattgttactaactaaaatccaaagtttctttagatttccttagtttttacttaatgtcagttttctgtttcaggatcccaatcaggataccagtttgcatttagtcataatggttccttaggctcattttggctgtgacaagttctcagacttttgtttttgatgacattgacaattttgagcactggatattttgcagaatgtcccttaatgggtgtttatctggtgttttcctcaagattcaactgcggttatgtgatgtatgtaggaaaaccacaagtcaactgctattttgacatatttatcaaaagtatatgattaatatgacttatcactgttgttaacttcatcacctggctgaggctgtatctagtcagttttctcaactataaatttcctctttcttgtttccctttcatttctttggaaggaaatcatgatggacagcacacacttaaagaatgggtagtaattttattagaaatgtaaattgtttatatttatctgaagaatgtttgtcataggacagaagaaaataatattggacctaagtcatttccatgaagaacatccattgtcaagggtggtggtggtagcatcattcattatgacagaatctggaaatgtttttactttcacagcatttagttattattttgaagaactattatgcttttctgcctttttgaattctattttgtacaacattgacaagtatacttgcatgcatgttcatgtagcactattcacaacagacaaaacttggcaaaagcccacatatttatcaatgaataaatggataaacagattgtggtatgtacacacaatagcatatgattcaagcataaaaagaaatgaagtactgatatatacaacaacatgaatgagccttgaaaacatcatgttttcaaataaagaagccagacaaaaaataaggtcacatattatacgatccatttatatgcaatatctggcagcagtaaacatattggtggctacaaggagctggggaggggatatggaaagcaactgcatgagtggtgccagctctttttggagtgattaaaatgtttgggaactggatagaggcggtggttgcacaatactgtgagtgtaccaaatgccattgaattgttcactttaaaatggctaatcttattttgctaatttatgttaaataatttttaaaagtaattatactaacagacctgtatttttttttttttgttcataaaatgtcttcctttgtgacagttcccagacattaatatttgccttccaattaaaaaaaaagtccctcttgttaaacatggttaatagtacattttggttaagctcattcccagtctggttgctcataaaaacttgtaaagcaatgcttgagggtaaagttttaggaaacacgaatttctgttggtggaattttgtcagtacaaccttgtctagaatgtaataactctgtggttccaggattctttgatatttttatacagtataagacagactgcgataaaattatagcttaaaaaaacacaaaatgtttaaattttcaaagtttcggaactcactcagatccctagaggcactataaagattattcaaacctaaagacatttgagattcaacaaacagaaagaagtcttttctgaacttcttttatgtcactaaaagcagatacttatgagagtgaggctgccatgaattccctctgccaagaaagtttatgaaaatgaagaaaaaacaaggaaatctattcttacctacataaacatgatcacaagctattttaatctcccctttgactcctagaaacctagtttttcttcccttagaagcctcctccctctcattgtgttaaatatatacaccttcttctttagctgtttaaggagctgtgtatatgcactcccatatgtatatcaacctctaggccagttgaaaagtagagtaggagcaacatgtggcatgtgagataattttggtggttcacaaattaactttataaattattcttaagatgtatgaattttgaacatgtagaaaaatattaatttaaaataagcgtatgtgtatattttaaattttaaaaaaaaatagctcatcaaacttgccacttttttaatactgatcttttatttaattgggttatagctatgtctataatatatgaattaatagacaaatgatgtaatgatttgttcagtcagcatatcctgagtagcttccaaggggcagattccaatacactgcttctgacggtcttaaaaaaatgatgaggacatgtttcctcatcccattattaagagagtcatttagtactgaaaattactaatgttaagataatgtgacctcataaagattagtaggttatattttcacatatatttccctttgtgttgcatcatccagtgttttaaatcattaagtaatctcatcttccatatttctaaagttatattaaagtttaagaactaaaacaaatctttaaatttctaaatatatatatataaactggaagcttctttaataggggtggtaaacttttgttacatttattaatgattttacatttgacatttttctcaataacaaataagttaataaaatgacatatttaatatgtatttgtaaatttacttgtggcactggagttaatatttgaaaatttttttatttataaaatatttatttatttatttatttattttagaaatgagaatctcactacattgcctatactgacttcaaaatcctgggctcaagtaatcctcgcacctcagccttctgagtagctaggactataggtatgtgcctggctttaacccaccatttaaaataatgattgcttatgaagttttaaaagattgaattaatctaaatttaatttataaaaatagtaaatagataataaatattaaatatttataatattttatgtgatacatgaatgtagcatgcagatataaacacacatatatatgcatatatacacatacatgcatataaatgccagaggcaatatttctacccttccatgtcactcagccttctttatatgtaatcatcaaatcactataataaacaaatttgaattttttaatgttatgttttctttcagtctgtcagcatcaaatctctcactattatctgcttctttgggtcattgtcactactccatagaatagatactggtgtgttaaagatagtgtatttacaggaagtgtataccaaaatacataataggagttttttctcatattggggaaagatattgcttacaaagtgttgagctctaaaatttgtatttttaagtgggaaataaaaataatcctggcaaaatgattgtgagcagagatgtagcaacaaaatctactaacagtttccacacgtgggaattctcccacattttatcaccaacacatatcacataggaaaatatataaaaatatgtctcatgcacactcataacttgtgagcccataatggtaatgctaattcatgatgttctcccaatttggaatcagatttgatcttaaaatatccatttaaaaaataatccttcagcaattgagataaaaatcaaaacaaaaacaacaaaaacagaaaaaacaaaacaacctacacttttgatctttatagtaatatactactgctcaaggctcttctgagtaaatgaaataacattctaaattgtgagtggtaaaaaataaaaaataactatttctataaacattccatataatttaattatgttttcatttacgttatgtgataatctaatatatattaaaatccacaaagaagatctcctttcttccctttcccattttcatctgcatttctcttcttttttaaaaaataagaatatatatttaacttcaattatttaaaaataacaggatattacattaagttaggaaactgtgattctagttggcaagcaagaatatcttttaaaaagttaaacaagttcaaccagtactctgaacagaattgtgtctcctcaacctcaagctagaaaatctagagtaaagtgatatgtttctggaaacacataatgttccaagatcgaatcaggaaactattgaaaccctgaacagatgaatattaagctgtgatattaaattagtaataagaaacttaccaaccaaaaaaagcactggaccagatagacacacagctgaattctaccagacatacaaaaattgactcaagatgaattaaagatttaaatgtaatacctcaagctataaaaatcctagaggaaaacctattaaaactcttcttgacattggctttagcaaggatttcgtaatgatgatatcctgaaaagcaattgcaacaaaaacaaaaactgacaagtagcacctaaactaaagagcttcggcacactaaaataaactgtcaatacagtaaacagaaaatggaaagaatgggagaaaagctatgcaaactatgcatctgacaaaggtctaatattcagaatctataaggaacttaaacaatttaagaagcaaaagacaaacaatcccattaaaataggggcaagggacatgaacagacacttctcaaaataagacatacatgcagccaacaaatatatgaaaacatgctcatcagcatttatcatcagggaaatgcaaatcaaaaccataatgagatatcatctcataccagttagaatggctattattaaaaagtcaaaaaattacatatactggtgaggctgcagagaaaaggaaatggttatatgctgttggtgggtatgtaaattatttcagacactgtggaaagcagtttgaagatttctcaaagaatttaaaaccaagctaccattcaacctaccaaccccattactgggtatatacacaaagaaaaatagtgcattctaccaaaaagacacatgcatgtctacattaattgccatgctattcacaatagcaaaaaacatggaatcaacctaggtgcccatcaatagtggattgcataaagaaaatgtggtgcatatacaccacggaatactacaaagccatagaaaagaatgaaatcatgtcctttgaagcaacatggatgaagctggaggccataatcctaagtgaattaatgcagcaacagaaaactaaatactacataatatcagtttttcaatgggagctaaacaccaagtgcccagggaaataaacctgggaacagtagactgtgaactgctggggcaaggagagagaatggatcaaaaaactacccattgagtactatgctgaccacctgagtgcaatacacccatgcaacaaacctacatatgtactccctgtgcttaaaataaaagttgaggaaaaaaataatgcttctatgaacattaaccagaggaagttgggtattctattgtcttgtaaacattttttgtttgagatatttgcctaatatttcttattttttatgcaaaccagtagacagaattatattatcatttatagccccaaatgctcatgtatctttagtagccaaacactcagtaaatattaggtcccataaaccatcacctgctatcctcccatttcactctcactcctcagaaaatgcccaagaaacttgcagagttaaaacaatggggttacaattaacactaattccacacatcagtaggaagcagaagtgagggaaggtcagggtagaggttatttctgaaaagttgtttacaaggttgaaatataaaatatagaaaattaattttacctatacaaacacatatgtttgcaatgcttacacattttatttgaatatttctgtccataaagataaaaaattgagctaataaagaaatagtaatattataattttaggaattatatcttgttaggaaagatagctagcatcccttctctagattttgctatttgagaaatatacaacacccttgctattcataaaataatttagaaattataaattattcttgccatgattctaaattaaatttaggccgggcacagtggttcatgcctgtaatcccagaacattggaaggccaaggtgggctgatcacttgaagttgttaatggtttcagaccagcctgtccagcacagtgaaactccgtttctactaaaaatacaaaaaattagctgggagtggtggcacatgcctgtaataccaactactcgggaggctgagttaggagaatcatgaacacgagaggcgaaggctgcagtgaaccgagatcacccccctgcactacagcctgggtgacagagcaaaaccccatctcaaaataaataaataaattataaaataagtaaatataaacttttttctttctggtaattaagaaatcttgattacaaaagtgttcttatatatttcactcaggataacaataatataaaagagagtttgctttgaagaaaaatgatatgtaaagagattactttgattctatgtgaattagggtaacatatcaaagttgaggttataataatatgtagtaaatttcaacaaaaagaaaacccatttgatctttctagatctacccccaaaatttttgtctggaattaatcattccttcattatgtatttatatttgaagtcaatagcatgggtgacaatattgcaaatattctcaaaaaaatatgtgacagggttttctaatatgggtcagtcaaaactcaattaccttaattacggatcataacatgtaaacacggataaaaagaaacctccaaactacatgtaatttgaaggattctcttcgaaaatcaaatatttttaacataagcaaaaccaggtcaaagctgggtaatgttcaataatttgtcatgatacctgtaattattcttttagaggccatatactttaaagtcaaaattgattgctcatatcttaattctccttatgacttcaagataatatattggtgcttaatgtacatgacttacattgtgcataccaccaacacaatataaaaaaccactgccaggtgcagtggctcatgcgtgtaatcccaacactttgggaggctgaggtgagtgaattgcttgaggccatgagtttgagaccagcctgaccaacatgctgaaacctcgtttctactacacatccaaaaattagctgggtatggttgcacgcatctgtaatcccagctactcaggaggctgaggcacgagaatagcttgaacatgggaggctgaggttgcagtaagctgagatcatgccactgcactctagcctgggcaacatagcaatactctcctcccctcccaaaaagaaaatccaggtgtggtggtacgtttgtggtcccagctagttgggaggctgaggcatgagaatcacttaaaccccgtaggcggaggttgcagtgagctgagatcgcaccactgtacttcagcctgggtgacagagcaagactgtctcaaaataaataaataaataagcaaacaaacaaacaagataaatgtaaaaaaaatggaggtacattttagatatatggatatcattatcatatacaaacaaagatatgttagacttatgttactattggtatatacaaaacagttaatgattaacaaccagctatcagataagtagccctgatttgtagcactggcactttccatactgtaaatgctcccagcatggctgcaaatgtgagatcactgaactcagagtttgaaagagaaacccacaattggccctcaagcaagtctcagctgactttccacctccaacaacccacagttttaagttacagatttaaaatgttgtgaaaatgagcatccttctttatcatttgtggaagtgtgatatgtcacaacactttgaaaaataatatagcattatctactaagattaaaaagtatgtgaatatatatgtacaaatacacatacacatatacacatatatatgcatacatataattttctcaaagcaattccatttttaattactgatttttaaacagtaaagtaccagtattttagtgatttatataatactgtaataatgtctcaatatatttcaagcattagtctaagtacttttttgtttgctaactagctaattgtaaccagaacaatgtggtatgttttattaatatacccattttactggttaggaaattaacatacaaagcatgccccaaatcacacagccagtaaatggctgaactgagatttgaactcaggtgacataattcactacactcactgcctctcttgaacatcatgagggtagatatcaatttggtgccaaaaacaaatgatcaaataaacaaaaacggagtattgttgaatcaatggtgatccattattattatcttacattatgtagctattaaaattatttgttcttaaaacttttaaaaatgcttaaaatgttataactttctatatttaacatttcattgtgtactgtatgacttaagtttataacaaaaactgttattgcatttaaattcaaatgttcattcgacttcttcctaatgctattccttccttttgatgattcacatatgtacttctgttttataactttatccctgaaatgctaaaaacttgtcactacctcagtgatgagtagtccatcatgttggatagaagttgttccagatgtctttataaatattttaaaactagacaccaattcagaatcttttaccttgcatttctattaaaaaattatatctttttaattgcatgataaaaaaactagcttacaaataccttccacagcaatctgacttcataaaaaagacattctaccttttcttcacatcttcagttaaatagaaaaaagaattttctgtgtttttgaaaaactctgagtggccctccctaatacattttacttttccccatatctacagttttcactctgctctatgttacatgacattaaaatatatacacacatacagacacacacataatacatataacatcttataatatataattataatatataaaataataaatcatttttaaaatctgaagaaatataaataaaagcttccaaacttagcttcaaaaattagatctatatgtctatctacatatttctatctacatatccctaattatatatctatctaggtatctatctatacacatacacattctgtgtcaggtgatatatctctaagaaaggcaagaaaatgacaagtttgtggcacattttttcatgttaacttcttcagaacagctaattgaggttattttccttttagcatcccctgctatctatctgttctgctgtatgagcaagattacaacgcttaggagtcattaaaggcacaggatggcttcagagtatagctgctttaaaaaagaaaaggctattaatttagagcagttttaggtttatagaaaaattgagaggaaggtatatacaccatgtctccacacgtgcacatcctccccacttacaacatccctaatcaaagttgtacattggttacaattgatgaatctacattgaacaatgataatcaccaaagttcatcctttacattaaagatcaccgttggtgttgtacattctatgggaatggacaaatgtataatgatatctatccaacttcatggtatcatccagagtattttcactgacctaaaaatatttcatgatccttctattaatccctttctacctgcctttaccaccatatccctgacatccactgatctttatactatttccccagctttgcctttaccagaatgttatatattggaatcatccagtatgtagccttttcttaatggtttattttgcttataagtatgcattcaagatttctccatactttttatatctttatgcctcatttcttaacggttatttcaaaaacgtaagcttgtcacttaatatgggactttttatgtgacctccccttctagcttttttctcaaggggtactcccattcatcttgctaagaaaagaaaaatgttttcaggtcatcagtgtgcccagtctcaggatatgaactatacatagtataattcagaagtgaataccgcatatccctttgacacatatggacttcctcaaccttcgttcctattatgctgacacaggtgatacaagtctagaaggagatgttggatgggagaaaactctgaagagagtatcttcccagataaaagaaggaagaatcaataaacgtaaaagaaatcctagttttgctaccctttctgcctgttgcattcagacttgaaatgcagttgtgatgcttatggccatggtacacaaatacctcccagctgataaggcattgggaaaataaccacattccagagaagagggaagtataaggatggaaggaacctaagtccctggtgatataattgaactgtcaaaccaaacattgagctgcataattccagaaattttattaaacttccactaataataactataataaatgtctatgttttataagcatataagcatgtctatgttatataagcatgtaaggatatctatgttttataagtatataaaccatgtctgtgttttacaagcatatgtttggatgtcctgttattgttatctacatacattagcataaacttcagttatgggaatattagctgatatctagtgaacaattactcaataaatgatagccatgaggaagaacacgaccaattaggcaatgattctttgcctttagtgtaccttagaattccctgaagagctaattaaaaatgcagatattccacttccatcatctgagatttttattcagaacatctgaggtagggtccagaaatatgtatatttaatacacacccaaggtgattctgctgctgttaatttgcaggatcctactttgaaaaatatttcagtatagtctaaaaaggttggataatggataatacatatgaataatttagaggtcaaagaatacagtgaataaaaacaacctattctatccctttctccatctataagagtattatatataaacaccaagggcaggagtgccctgatgaagaagtgagtggcacagagctctccaagagtatctgatacattttggatgagttttttacttcataaattcacagaagaaatttaaaagaaattgaatactcacattagcttggattatgacaaagtagcgagtcttatcttcatagttgagcctcttccttaacactatatttccagtcaacattaggggaatttcaaaggtgtcattggatgtctgcaaatattaaagatacagacttcagattatttgaatgtaagatgaattaataactcaatattttggattaatcctcttggaagttagagatgacatgcttatcatctgaaaatagaatgactataagcttcagagtcaatattgttatcatacttccaaacatttaattttgatcaatgggtttccccagagtcctttggtaataataaccagaaaatttgtttcttgtcatagtttttaatatattactagtattattcatcaacagtcttggaatagttctaaatcaaagtccaggtatctgaaaaacttccctgttaccacattatcttttcactgtgttctttaacaccaaagcattcaaacactgaaatctgttatttctacatagtatcaattgtcaacattgatatccattctgtattttaagtatttttaagtattatctggcattaaatacaaaaaaaaaaatacagttacgagtcacttagtgatgaggtacattccgagaaatgtgttgttaggtgatttttgtcattgtgtgactattatagagtgtagattcacaaacctaaaatggtacagcctactacatactaggacaagtgatatagcctatggctcctaggctacaaacctgtacagcatgtcactgtactgaatgctataggcaattgtaacacaatggtcagtattttctctataaatgtaatctaaacatagaaaaggtatagtagaaatacaacattataattttatgagaccaccatttgctatgtgatatatcattgaccaaaatgtcattatgcagagcatgactgcgtgaacttgaatcagttcattattgtggaaaaaaaaatccaggttatatatcatttttttcttttaggttccacaacttctgctcattagttaagttctctgccctgtctaggactgagttttttcctggtaacatggaagtcataagggcaacactagtgctctggtataagcagccctcagtgtaactgtattcacaccttaagggagtataatttataagataaatctcttattcttaagaagaccttatgtcacttttgtattttagtgccattttaaagaatgataaaattgtttctagtaggctcaataactcagtgttattttgttcactgaaattgtcttgtggttgttcagttgccttgtgtatttgtgcttgtgatttttttgtgaaatatttagtttgaatctgcattagattgctgcaaaaggaaggaaagagagggaaagaaaaatgagaggaaaaggcaaggggaaggagaagagaaagggaaggggaagtgtggaagaagaaaaaaactgtgtatgtgagagagaaacagagagagagaggaagagagagagagtgttcacaccctcaacttagtgtaagtgtattcctaagagtcacataagaagttaaactcaatgaaaaaaaaaaagctgattcaaatctctcagctcaggctcaatcaatgaaatgtgtgtagtttagccttccatgtctagagctgtgatctgtctcctttctttctttctttgtctctctatctctctttctctcggggatgcataaagacacacacactgtacattttgcagaattaatatatatttttaaatgattcattctgtgctcctcatgtaatgggccttgcaaatcgttcttggatgcagtcatttaaaagtaacaatttaaaatataaatacagaaaatgaaaatgaacaacacaattaaaaacagacatttgacattttccctaattttttgcctattcaactttgcttatacctatgagtggggctggcattatgacacaggagtgtgaaaatgattgaatctaaacatgtaagttgaatatgggcaaaaccttagttaataattgctgtttacactgttaaacttatcctaatgtgttgttatgaggttattacattttagtgactcaataatatagaaatatatattggtttctagcataaatatggaagatactgtggtcttaccacaaaactaccacatctctggactcagaaccccaaattagctcacatatctggtgacattgtgcctcagaggaggctatgtctctaaatgagatgagtcttgaatagtctagcttaaaaacagtaattccattctcttttaccaggaagtattttgcaaatgtacatgtgattccattttgagtaatgaaaaaatttctcttaattgcaaagatagagagaagctaaaaatcccttttcaggttatagaagtttctgtcaggatataaaatttagaacttcagcagccatttggggactattgataaaattaattacggagaaatagctaacatgctagtgatagcagagtataaaataaaaagagcccggatctgtgttgtctttgagttgctgagcaaatcttgatattaccccatctctgaaaaacttattatgatagataataaattacctttttggttaaatcatctttaatttagttttttacatatatataatatatatataatctatattatatattattatatataatataatataatctatattacatattattatatataatataatataatctatattatatattattatatataatataatataatctatattatatatataatatatatatagtaaattttctgcagctgaaagcactttgatacatgattattcctgtctctatgtgtttacactgtaggcctctctcttctccaaacaggccatggctcttcacacctgatatttgctcttatttttctcttgcttaaatatcccatcacttatttctctgtgtactaatctttgcaaactttactcagtgaaacctcttaaatgtaatttagacttaagtctttgatgtgatctcacattattttttccaaaaaacacttatttgggatcttctgttttgcttgacagattcctcaagggtctcagtctgtgatgcagaaataacctatccttaaatgtctagctaagcaacttaatgaatctttgcaatactttttttgttgttgacagttttcattggacgtttgtagaattattaaaaataatagttattagtgactttattgatcttcagagcactttcaattgcactgaattcttatcatcttaaatctatcctttagagattttatagattcttagattttaattttactttttatatgtatgtatttatttatttatttattgagatggatgcagtcttgctctgtcatccaggcttgagtgcagtggtgcaatctcagctcactgcaacctctgcctcctgggttcaagcgattctcctgcctcagcctctgagtagataggactacaggcatgtgccaccacatctggctaatttttattttttacttttagtagagatggggttttaacatgttggccagtctggtctcgaactcctgacctcaagggtatgcccaccttgcctcccaaagttctgggattaaagatgtgagccaccatccctggcctagattttcattttgttagcacttgtattctataaaatataagaataggatatactttatcatcaatggtgcttctgaaatgttgcatattgaaagccactgtattaaatttaatttattaattaagcaattattgagtattcattctgtctctaaaatgtagaataataatcaagaaaattagaagcaaaatatagatatctttggtatctttatgatagtcttctttttcctctagtaaaaagaatactggattagatcaaccctaagtaaaagtcttgctttaatgatatttctgaagtgtttacctaaaaagtttaaaaaaaaaaaagctaaattaagcaagggaaaaaagtagattttttaataaataaatacatgataaagccatgaaaaaaacaaaacaatacttagaacattcttaaagtttagaatgcacaagaatcataggcatgtatcattaagactgtagattcctagcatctattacccaaaattcccgaaattcttgggaatcggcatttttaacaaacctaccaggtgatcctgatgcagatgattcaggttttacttttgagaaaccactgtactacgtaagtctaagagtgactgcactctctgtccttgctatttatttttctcttctttcattcttagagatttgttccaccaatgaggcagaaaagtttgggaacagagcaatgcccatttacttaagcaaccttacatttctaaagccaggacattgccccctttctgatagtcgtggatattctctttaaaatacaaactaacattggcttttttgggtgataagaatttaagtgctgactacctgcactgtattaatgagaaaaatccaattatggttaaatgatttaatacccacacgccccaaacacctggcctccattaagaaaggtccactcactactttctgacagttcagtgacaacaactgtcaaataagggacaattctccatttagtaaaataagggcataaggcagtttaagcaatttatcactatcacagatatgggaagcagggtaggagacagctgtaacatccacgccacacacattcacattcaataatggagagagaaggaatgttgaggctctagcaactctgtgtttcccaagatgattccatccccccagaatcccctttactaatatgggtttgcaccagtttagataaaacggcagctctctgaaaggaggtgttgaatcctacagttaaagatgctctagaaatggaatatggggttattagcactatttcttctcagctgatagatttggtcattcatcatttttaggaaagagggaaagactccagcctttcacacctatgttgtaagcattgtttgtaatattctcttttcagctgtgatgactagaaattcagttcaaaagaagataatttctaaagaacacacacacacacacacacacacacacacacgtgtatatatattttctggtgacctaaagacagagacttagtacaaaagtgcctcaatgggcctgtaattgagaagtggcggaaatgtagataattacgattttctctttatctctgtaaattctcttgttctttgacacttttttttgaagtatcttcccttatctttgtgtctttttctgtacctctctcttctctctttgggtttcccccatttgttcacattgaatataactgtgagtctgtgttttagttccaataagcagcatcaactttgcccttatcaatctttagacagccttaagcttgtctctgattaagctcaggctactgtgccatcagctgctgaaaattctatgttattgtcattgtttgtgtgtctcctctaatctaatttcctaaagtaaaaagtggaggactaagtaaggctatgcaatttttgtccacccaagagggactgggatttgagcaggcaacattaactttgctcctaagagaaagtcccaacactctaatcattttttctgtttcatactgttaaaacatgtccctggctgacagacaaaatggactccctatgactaactgaagtaagttaaaacaaaaccaacaaaaccaggtggccatgcctgagtgacaaagtggtcgcatactctgtgttctcagaaagatgtcaaagcatcacaggatcttcctttctacaattgatatggtttgggtgtgtcctcatgcaaatttcatcttgaattgtagcttccataattcccacgtgttgtgggagggagctggtgtgagataattgaatcatggcatttccccatactgtttttgtggtagtgaataagtctcatgagatctgatgcttttataaagggaaatcactttcacttgattaaattctctcttagtctgcttccatgtaagacatgccttttgcctcccaccaagattgtgaggcctcccaggcacatggaactgagtccattaaacctctttttctttatacattacccagtctcacgtatgtctttatcagaagtgtgaaaacagactaacacagtaaattggcactggtagagtggggtcctgctgtaaagatatcaaaaaatgtggaggcaactttggaactgggtggcaggcagaggttggaacagtttggagggctcagaaggacaggaaaaggtgggaatgtttggaacttcctagagactttttcattggctttgaccaaaatgctgataatgatacggacaatgaaatccagggtaaagtgatctcagatggagatgaggatactggagtaaaggtaacccttgctatgttttatcaaagagactggtggcattttgtccctgacgtagagatttgtggaaccttgaatttgagggagatgatttaggttatttggtgacataagtttctaagtagcaaaacattcaagatgtgacttcagtgccattaaaagcattcagttttaaaagtgagacagagcataaaaattcagaaaatttgcagcctgataatgcagtagaaaagaaacacccattttctgaggagaaattcaagccagttgcagaaatttgcataagtaatgaggaaccaaatgttaatcaccaaggcatggggaaaatgtctccagggtgtgtcagagacatttgtggcagcccctcccatcataggccaggagccctaggagaaaaaagcggtttcatgggccaggtcctggacccccctttccgtgtgcagcctaggaactcggtgccccgtgtcccagctgctccagccatggctataaggagtgaagacatagctcaggctgcggcttcagaaggtgcaagccccaagccttggtagctttcacatggtgtggagcctatgggtccgcagaagtcaagaactgaggtttgggaacctccacctagatttcagaggatgtatggaaatgcctggatgtccagacaaaagtttgctgaaggggcagggccctcatggagaacctctgctagggcagcatggaaaggaagtgtggggttgaagtccccacaaagagttgccactggcgcactgcctagtgaagctgtgagtagagggccactgtcctccagaacccagaaagtagatttactgatagtttgcactgcatgcctggaaagcagcagacactcaaggccaaactgtgaaagcagccaggagggaggctgtaccctgcaaagcaacaggggtggagctgcccaagaccatgggaacccacttcttgcatcagcatgacctggatgtgagacatggtgtcaaagaagatcattttggagctttaagatttgactgccccactggatttcagacttgtatagggcctttagaccctttgtttttgccaatttctctcatttggaatgtatatatatatatattcatacccaatgcctgtacccccattttatctaggaagtaactaacttacttttgattttacaggctcatgggtgtaaggaacttgctttgtctcagatgagactttggactgtgagcttttgagttaatgatgaaatgagttaaaactttgagggactgttggtaaggcatgattggttttaaaatgtgaggacatgagatttgggaggtgccaggtgtagagtaatatgatttggctgaatccccacccaaatctcaccttgaactgtagctcccataatccccaagtgttgagggagggacccggtgagagataattaaatcatgggggtggcctccccagccacgtggaactgtgggtccattaaacccctttttctttataaattacccagtctcaggtatgtctttatcaacagcgtgaaaacggactaacacaacaataaagcaaaaacagatcctgttcttggtgccaagataaactacagctggaactacttccttttgccccctatgccatccctacactggccctttagcactagccctttgaaagaaacatctgacagaaacttctggtttggggcttggaaatcaaccaatcagagctcacctgaatcaaccaatcagtgtatagaacagtcatgactcatctgttttgaccaatcagaattaagcaaggatctatccttcatttggatgaagacagcttattgggaacctgggtgggaactatagctataaaaccctaaccctctctttgttctctgaaatgtgtcttagcttgaaaccacaggctgtatatccatggtttgaaaactgttcactgaaataaagtctctttcgtccaaattcctttccagagaacatttgcttacaatataaatttaccactctccctcacacaaatacaaacagattcattcacatttaatgatgcattatgattacaatgcagttcaacttatcttattccatccaacttccaaggaaactgtatttgtgtttggttgggttttgaaacttaaaagtcacagccttggtgtgaaaagactgaggttcgaagttttacacaaagaaggcctttacaccagtcttaattatacatgagtttccagtaaaatgagaatattatgaatttatggaggcatggaaatctcatgatataatgtaccctgaaaagtattattaaactacagtaaattttttagtaacctacctaggaataagtaatcactgttttagcttaaccttaaatattttattgacatctgaaatttggactttgacatatatacacacacacagaactacttcaggatggtgatttttttaaaaatcgtttgtccttaaaatgtggttttaacttcctgactcaggaaattcaaatgcttacacattacaaatgaaaattatggcttacattttctgaattatctcaaagctacggggagtcaaacatattacaaaagaaggacaatttactcaggaggacttgataaaagatgttaccacccactgaaacaccactgtaatacctcaaagaaagaagctgcttatgcatattgcttaagtgtcttcattttttttttctgagtagtaacagtagtgaataacaatgttatgctgcttcctcagtaaactggagactgctacaagggacatgtcatcagtctcctccttatcactttaggtcaaacttaaaatgctgaataaacatgcctccagtctggcattaaaataaaaaaaaagatcaaaaagacatgataattattgtctaaatagtcttatcaatcttgctaacaatgagatttaatatatcagaatacctatatttagatttttccatataagacaaattctcaaaaatgaaagttactgcagatcatgtgatgacaaattcttatcaatttcagagttcttcttttattttttcaaaacaaactaattcaagcttgtctaacccatagcccacaggctacatggggcccaggttggctctgaatgtggcccaacacaaacatgtaaatgtccttaaaacattataagatttatttgtgattttttattatcagctcatcagctgtcattcacgttagtgtaatttgtgtgtggcccaagacaattctttttcttccagtgtggctcagggaagccaaaagattagacagacacctctgaattagttcagtgcattatgaacactcttactttgtattaccatgaaggcattaaacaaaaaaaaaaatcagcagtattttacaataactgtgatgagtacactagaaattgcatagaaattaaatgcccctaattaaaggcctgacaacatatattgtccagtacatatttttacatattgtctactaccaagttccaacagataattcaagtggtacttaataaacaaaaggtgaccaaatgagaaaatgaacttatacaaaagaaagaagaatgcttcttcttctgaacaatagtgcagactgacaaagattctttgcctggccaaacttgatcaggcttctgaatcttctcctaggctcatctgtatacttcctcataaaatcactttttaacaaagaaccatactatatcactttaccaagaactcctctacctttgatgaatgatctatcttgaaaactcatcaggtttctcatcctgcaccaccccttaggtgatgtctgatcaccctgacttgtcttcagcaacaatcgtattagcgtgttttagccagaattcccctaatctctgatgtttcctcctagtaattttccatccagtgaccctgaccctgctccttggttataaagtcccacttgcccatgctttatttttagttgagtccaatatctctctccaactgcaagacctcattgcaatgatttctatacctattgcagtggtcctgaataaggtctttcttaccatgttttaatgtatcattaaataatatttttatttaacaattgtctagaggacttttagaagaagatatttactaaattatttttttctaaatacatcagccatgaaaggatagggaatgctgcaggaacaaacccttaaactttcatttttttctttacttttcatatctacatatctaatatgcatcagcaagtggtctctttttattgttgtcattggctaatgaatgtttctcctcaacatgtttttctctgatcacaacagcaggggcagagaatatgattacttgtatattggttctttgagtttacatttcattagtcaaagcaaatacttttctccaggcaagaaaagtacacctctagtatgaatcaaaagagaggaagaaccaaacatttttggtaaacagctcaagtgcttttgttaacagcagtgaatccatatgggtctgcagcaactcggtcctaacctcagaggaaagaatgtgatttaggggaagaagtaagtttaaggcagagggagagattgaggtgagttttagagtaagagtgagagcttattaaaaagttttagagcaggaatgaaagcaagcaaaatactcttggaagacggctaagtgggtgacttgaaagatccaagtgccttgttcatcccttcacttgggggttttctacattggcatggtttgggggtttgccattctcctcccttgatttttcttttggggcaggctgtccacatgcacagtgcctgctggtgcacttgggagggtcttcatgtgcagtatgtttactgaagttgttgcatgcttacttgaggcatttttgccttaccagtttaacattcccagaaaaaggtcatatactagtgaaattctgccattttgcctcttaacgtgcatgcttcagccctcttgcccaacttctaagctcttattgggaagctgctgatcaccagcttcaagtgttttctatctattgggagactatatttccctggcactggctgtgatcaattattcttttacagaaaaagtttaaaagccacctaaccatcacctgacgatcagctgacattcctgggggtggtcctctcctgccctgctcatatctgcctaaccatctagttgatatggtttggctctgtgtccccacccaaaacaaattacaatgtcaaattgtaatccccatgtattgagggagggatctggtaggtggtgactggtttatgggggcagtttcccccatgctgttctcccgatagtgagttctcacgagatctgatggtttaaaagtggcacttccatttttgctctttctgcctcctgctgcatgtaagatacaccatgcttctccttcaccttctgccatgattgtaagtttcctgaggtgtccctagccattcagaactgtgagtcagttaaacctcctttctttgtaaattacacactctcaggtagtatctttatagcagtgtgataacaaactaatacaggaaattggtactgggatagtggagtactgttaagatgataacctgaaaatatagaagcaactttggaactgggtaatggtcagaggttggaacagtttggagggctcagaagaaaacaggaagatgtgggaaagtttggaccttcctagagactttgtgaatgctttcaaccaaaatgctgatagtgatacggacaatgaagtccaggctgaggtggtctcagatggaggtgaggaacttattgggaactggagcaaaagtcactcttgctatgctttagcaaagagactggtggcattttgcccctgccctagatctgtggaacttggaacttgagaaagatgatttagggtatctggcaggagaaatttctaagcagcaaagtattcaagatgtgacctgtctttttctgaaagcatacagtcataggcatatatgaagacattatgtgaaactggaacttatgtttaaaagggaagcagagaataaaactttaaagaatctgcagcctgaccatgtggtagaaaagaaaatcccattttctgggggaaaattcaagctgggtgcagaaatttgcataagtaacgaggaaccaactattaatagccaagacaatgggaaaaatgcctccagggcattttagggatcttcatggcagccgctcaaatcacaggcctggaggcctaggagggaaaaatggttttctgagctgggaccagggccccactgctctgtgcagccttaggacatggcatcctatgtccctgccactctagctccagccatggctaaaatgtacagttcaggccattgcttcagaggtgcaagccccatgccttggtggcttacatgtggtgttgggcctgcaggtacatagaagacaagagttgagctttgggaacctccaccttggtttcagaggatgtgtgaaaatgccagcatgtccaggcagatatctgctgcaggggtggagccctcatggaaaacatctactagcataatgcagagggaaaaagtggaattggagtccccacttgggactgcctagtggagctgtgaaaagagtcccactgtctcctccagatcctagaatgatagatccacagacagcttgcatcatgtgcttggaaaaaccacaagcactcaatgccagcctgagaaggcagctgcaggggcagtaccctgcagagccacagggacatagctgcccaaggccttggaagcttaccctttgcattaatgtgccctggatgtgagacatggagtcaaatgagattatttcgaagctttaagatttaataactgccctgctgtgttgtggacttgcatggggcctgtggtgcctttatttgggccaatttctcacatacagaatgggtgtatatacctaatgtctgtaccctcattgtatcttggaagtaacaacttgtttttgattttataggcttatgggttaaagggaattgacttgtctcagatgaaactttgaacttggacttttgagttaatgctgaaatgatttaagactttagggaactattgagaaggcatgattggttctgaaatgtcaaaaggacaagagatttggaagaggccatggttggaattatatggtttgtctctgtgtcccgactaaaatctcatgttgaattgtaatctccatgaatctagggagtgacctggtgggaggtgactggatcatggggcagttttccccctgctgtttttgtgagagtgagggcattctcatgaggtctgatggtttaatagtgataattcccccttcactctctctctcctgctgccatgtaagatgttccttcctccccctttcccttttgctgtgattgtaagtttcctgaggccttcccagccatttggaactgtgagtcatttaaaattattttattataaattacccagtcttagttattctttatagaagtgtgaaaatgcacactactgtaacactttcactttaaattggatcaatcagttcagcaactatttattcccaaacttgttgcttctttgttttagaacaccatttgaattgcaataaaaagagttgcttaagttctttgtagatttgcggggggaggtgggaggggagagggacagcattaggagatatacctaatgtaaatgacgagttaacaggtgcagcacaccaacatggcacatgtatacatatgtaacaaacccgcacgttgtgcacatgtaccctagaacttaaagtaaaataataaaaaataaaaaataaaaataaaaataagttgaaacataaaaaaaaagatttgcaacaaaacagaaaggctcaatttaattattccaattttattcatatattaaataaaatagttatggtgaagaatttacaatattttgctttattgaaatgttattattttgactagtaaaagtgccacactatggtgctattaatgtaagcagaattactagagatttagtagtagcagaacataaaatttatcatgtattttctcacaggtcttacaagagaagaaactggtactgaggtttacactaattttatatgaagtctaaaagtggattctctccctaagattgtaccttggttaatccttttttccttcaatacatcctaagttaagtgtcatgatgtcttactattttttccacagaattaagagcattttagcttgctaaaacatatattatttatttttcttttttcatttgtaattttgaaaatgcatgtggttgattggtttatccactctgtagggagtaagagttacatattatattgtacagcaaacctacacttccctggaatggggaggcattgagacagaattattgcacagttaaaaaagaatttaagccttattaactgtctacattttaagcagaaagatagtttaaagtaatatatttttgctctcaaactatatctaaacattgaatatttttatgcatgcaataaatatctccctaaaaaacatggactagtcatttgatacttgctgggaggttttatttttacaccttggggagtaaagattagaaagtaaccttcataaaatttgagctagaaacatggcgcacacgtacaattaattctttaaaaaaatacctaaagagcaaacaaaataaatggtttcaaaatcgaatgttcagtcagctgtttctacatttaagaaaaagcatttctgctgcccttttctttgctgtttctttgctacttcccacttcatttcttatgtaacccttcatactgtccttctctgtcacattctcatcatatccccaactcttggttttattgtctctgcctaaaaaaaagtcctcttttagagaaacaaagcaaaaaaaaaaaaaaaaaaaaaacaagactctaaaatctgaccttcaccctgctaataaaatgtatatatatatattatatatatatacttattttccaaatttattaaaattttaacacagccagtacaagttttttttgtgagaacacaatagaggaagagtatactgaaactggattttacagttcagaagtagttttctaatatgacccaaatcacttcacttacgagttttctttgctatgcaacagagataatactacttttaactgatttgtgaggataaaatgagaaaatgcatccacaatttacttaacataatgcaataaatttgtgatgtagatcttactgtgagttctcagactctactatcccaatagagttttttgtttgtttgtttttgcttgtctgtctaaagtttatctacaacatacaatggtaaaaataagggcaaaatgttaacttcaccattgtttatatttctaatatttattaaacataaaagagatgcattcaatttgaaagcttatttaagtagtgcatttataattgctttggggggcccgtgggattttgaggagctgcctcaaagaaagtggggagatgtgaggcaaggcttccagctctagcttcagttaaaaaaaatcttactttgtctgtttttttgaataatatgtcattagaggaaatgattcatggccttaaaaaacaacatagaaatcttcttgtctatttgggaggccgaggcaggcggatcacgaggtcaggagattgagaccatcctggctaacacagtgaaaccccatctctactaaatatacaaaaaaattgagcttccagtgagccaagatcacgccactgcactccagcctgggcaacagagcgagactccgtctcaaaaaaaaaaaaaaaaaaaaaaaaaaaaaaaaagaaatcatcttgtctaatggaaaaaaaggaagaaaaacaacaaaataaaacagactatagctagtggctttgtcttgtcttcttctctatctttggtttaactggtggacggctagaagtttaaaggcttatcaactccagcaatacttggtgtgtgttcttgaggtatagcaacaatattggtattaatttatgagttgcataaaattcatgtttgacacttgttatctcatctccagtgatttatttagaatgctttggagaccacaaacataacagaaatttagtaaatgaggcatattatacctatgaatatattttaaaccttatctaaaaataccatcaaaaattagcttctagcaataaagcataaatattacaaataattcaattttgagacatttttaaataatagtatcattactaatctggttctggaagttactgaataatacaataactatcagctgaaaaaatcattaattttattccttttaagaaaattacattgcaaataggtatttacataccggatcatctggattatactgaataacatactctatctgtccatttggtccatcatctatatctgtagctccattgtctcctgaaaatcctgtgaatattgtggtaccaactggagtgagctgaaaggaaaaaagattttaaatatcaattttcattttatcaactgcacaccagaaatgttacagcataaaaatcagctctttattacctaaaggaagataccagttggcagcccacaaccacaaactgaagtgtttcaaaagaacagttttgagccttacacaggagttcttaaaatgtctgaaatgtccaactttgtgattcttgctatgggcgaagaagcagaagacgctgattccgtgttaaacacatttggaccaatttatagccattagtatgttagctcctgtggagaaactgcatctgttgtttctcctcaaaacccttgatgcaatgttacccacaggctagaatttaaactgtaagaaaaagttagtttaaaataaacgatttacgagtgagcaatgaaatccaggctgatgattatatgcaagtggcaagtttgagaaagagaaattggagacaatgaatagtctgtatattagaggaaaatactgggagtttcttgagtccttctgatattggttgagtagaacatgatcaggtcacagcagctggagagatagcaacatcttttcattttggattaaaacatcagaacttaatatgtgtggcatacaaaaccatgatttgatgtgtgacctaaattgctagtcttaattcttacttatgcccacaagagaatcaccgttatttttttttacctgtaggtttttgcgcaatgtgctcttataaccagagtaatttttttaaattttcccctcccagtttttaggttttagctgaaatactactcattagttaaatttcaacttaattagatatcagcttctcccataccacccctcaaatagcattacacacgccacatcagaagatgattccccttttcttgtgcttgcattttgcactttgttcctataatcattgcattgttagaggaactaaatgcacttcatcaataaacataagctctgtgcctctacagactggacgcttttaatgtttgctcagggatttgttctcttaatttttgactaggattccttgatggtaaaaatagcttaagaggcaacaaaaaagttgccttattcagttttactttcagaaactgaaaattcacattttacaaggatccctcaggtaatgtaaatgagtgaagcaagcatgatgagacggtggaaaatagatagaacatgccctctctgatgctactcagagagggtagctgctactagtagctgctactcaatcccagcaaattcttgccatcttggaatatggagcccatgctaccaagtcttctaatattttaattgtatataaaatatcttgatgctaagattgacaacagatttttattatttatttatttatttttgagatggagtctcactctgtcacccaggctggagtgcagtggcacggtctcggcttactgcaagctctgcctcccgggttcacgccattctcctgcctcagcctcccaagtagctgggaccacaggcgcccaccaccacgcccggctaattttttgtatttttagtagagatggggtttcaccgcgttagcaaggatggtctcgatctcctgacctcatgatctgcccacctcagcctcccaaagtgctgggattacaggcttgagccaccgcgcccggctgacaacagatttttaaacattaaaatataaataggtaaaataaaatatgcccattgcctcaacaactacactagtttgcaatctctgatttaggaaaagaatataattatgacttaaaaataaaccataagtacaaggaagttcaggatttataaggcccagtttcctagcaggcagcattgaaggcaaactttggagagctgagaatgaagtgagacgagatcgtttaagtagtacctatgaggacatcgagggaccactggggatagatttagtagaaatgttagtcagctaaattgcttccaagctgacgttcaatatttttcttttttaatggaattcctgttgcaaaagacatccttatcttttataaatattcacccattcttatgtagctgtactttgatatttttattaccaacttatttttaaatcaacatatagaattttgtatatttgttgtgtacaacatgttgttttaaaatatgtataccttgtgtgatggctaaaccaagctaattaacatatctattatatacttttttgtggtgagagcacttaaaaaatctattttcaaaaatagatagttattaactatagttaccatgttgtacaatagatttattgaatttattagttcaagaaatttaaattttgtatcctttgaccaacatctctcaatccatatcccagcccctagtaaccactcttatactgtctgctgcaattacttcaactactttagattccacatacaagtgggatcatgtagtatctgaatatctgtgcttggcttgtttcacttaacataatgtcttccaggtttatccataattttcaaactgtgaaattttatgattggatgacattgatttgtttccatatatctaataaacttaaaaattttgttgccaaaaaatactatgtcatggaggtagatataaaagcaaaacaaaaaatcaaaataaaacaaacaaattttaaaaaattaaacagtatcgtctgtggaaattttgaggaaataaagggggtgcccatgcctttcaatctgcttactggggtaatgtatactattggaccagatttattttgaagagcaggatcccaaagccctacaacttagggagataaaattggtcttgcggggaagatataggacatccagggagaacttcacgtttgccactcttaatcaagattaaatttctggaataaatatttatatgacagaaatttgttggaatagatggtttgaaagattttagtccttacaatgtaatatttgtaaagttgaaggcatatttctaaattcaatatgcaaactattgaaaagatcaatgtttttctctagctctacaatgtttttttgaaatgatgaaaaggccacataaaagtagcatgatgtcttaatatattaccatcaagtaatatttttcttcatcactgacatggctttttccatgcagaaatcacatttgtaagtataatgtttaatatgtagtcctttaaaataaactctacattgttataatgtttaatatgtagtcctttaaaataaactctacattgtatttctttgattgactttcaaaaaatatacttgctgatgaagcctaccaaagattgataatagaccacaggaaaaaaattgaatatgcatttgcttatggtttcaattttaagcttaatccaaagagtaattcaatttcaaatgttctcatttcagaatatgagctcattttgtgtgccacaggtaaatttccctaatcatatttgtgtggccatatatacttttattatttctgaaaaattgcaagtagaaatatgattctataataaatttcattaatttatatctttgaatagaaaataaaagagaaacaattgtattagccgtaggaatagagaaaaccttttttctataatgatattatataaaggttatgaatcatccctaaatataattttaaggtcttttttagacaaaattttagattccttgaaaattaaatgaaaagcattagtgtaatagcaatagatttcagcatgttctttcattcatggctgtctttcttgacaatttcagtaaaaatttctccctaatttcacaaatatggtatttactggctgacaggggaggatgggcaggctcaggaattgtcccaaggtgaggtttgctctcctccatagttccacatttaaggcaaatgtcttagcacagatcactcctgtgtatttctactactagattgtgcaagcatgtacaaatagccattcatatgtaaaatgcaacacaaaatggatcagtcatacatttttctcatgatctgctcaaatttcatgatttgttcaaatggtagacctgttcacatatgagatagggttgaggctaatatgagagaaatagccgagaaaaaagaagataagttatatgggcaaacatgggaggtctgaaaagtctaaaaaggctctaatgaagaggcctatgccagatgcaaaaaagcagaagaaagtagaagcagaaaaaatgttttttaaaaaatagtagatcctggccagatgccatggctcacacctgtaatcccagcactttgggaggctgaggcaggaggattgctgcttcaagtctgagagtttaagagtttgagagtagagatagatagatagataataggcctggacacggtggctaacgcctgtaatcccaacaatttgggaggctgaactagatggattacttgaggtcaggagttggagtccagcctggccagcatggtgaaatcctgtctctactaaaaatacaaaaattaaccaggcatggtggtgcacacctgtagtcccagctactcaggaggctgaggcaggagaatcccttgaacccaggagactgaggttgcagtgagctgagatcgtggcactgcactccagcctggggcgagaacaagactctgtctcaatttaaaaaaaaaaaaagatagatagatagtaggtggttatatgtatattatattcagatcttttttgtgctattataaaactgtgaacaaagagacctaccttatgtttcatagataactctttaatgctatatctcaaaatcacaactaccttattatcattacaaaaaccaaacaaaagacatggcagaaagcccacacctaaatgggcaggtagcattgaaatgtatgcaaaaacagagtgttagtagtgaactgaaataaatttaaaaggtccctcttgacagcctatttgcatccaaaagctctttaaagacagaccataatttttttctttttaaaaaaatatttcatagcatcaattgtagaaactggttcatcagtagaaactcaattaattattcttatttatatatattatttatgcagatgagactgaaacttttcacaatttcttcatattttaatatactaaatcctctacaaggcctctatactggaatactgtatccacatcctcatcctctacctgcctgttcctggttcctcggacaacctcacttttagaggtgatttccacccattcattatgctgttcaattgcaacaggatggccagagcttctggcagctcactgtcaaaaaaccctgcccacctttttttgcttccatgaagaaaaatatgtagatttcactgtgaagtctagttcttcccatgctcttgccagttttcctacaagaaaattttctacagactgtccatgaataaactataaccataataggacccaatacagcaagcacatgcaagtagaataaccttatattcacgaaaccgatggtatgctgttcacttggaataaaatattgagaaggatatgtggtagaaagtcctccacaaatcataatattgtgttgtacatatatatttggtgattagaaaattccactggcatcaatatcattgtgttggtagataacaatgattttctgtttcatattttctggagtctcatgtgtcatatcaacacagaaacaaaaagtttagtaaaaaataaaatactaaaaaatgatttctgaatacctaaaatagtttacacatgtattccacaccaatgccttctgatagattctaatggctttaatgattaaacagaaaccatatgagagtcctaagaagagaaaacatatatttttatgtaatagacacaacttaaataatacctcttcaactggaagacaattggtacaaaaggatattattcaatttggaaacttgcccccaaaaagagccaccctagaggaaaaatttaaaatacgattgatgagattttactttttcccatgcttcctcaagaatccaagttttttgttttctcctacccaggaaaaatggagaatatctgaaggatactgaattttagataagctgaaacagaattaatcactacagttacttatcatataatgatgatttgatgaaagaaatgctaccggggtggcaggtgctctatttctactaatagacattaacaaaaaagaagcattacctttagtgatgcaagattacatatcagcctatgttaaaacactacacatttattttccaattgttaatatcattgatctgatttatagtattaggcagccacttcatgtcaattaatctcctagaaaacccaatcaagataaggcaacattctgtacaaattatcattactagtgaaactgaaggaatcttccacgtttaatcaacaatgagaactatgattcatcctttaactttctccccagataaaataatgttatagattcattcttgcaattaatccctgccttggaaatatgctttagaaatggtaaatttagaaattttaaaccaaagattctccacacatgaaatccagagttgattttgtaaacaggcagtcatcagtggaatattattgaaaaattcaacattttctgacaattatgaaattacaatgtctctgaatctacgattatttattgagaaaatatcgtttgccaaatcattgtttctgtgaccattatattggtcttactttaactagtaaatataacatttgttttattcaaccatttttccaaatcaaacatccgtttgaagtccatcttaaaactttccagaactgataaaaaaaatacatattcttgaattcaaatacagtgcaagttatcttgtaatgatttattaacattaaagaaaacataagaaaagaggtatagccctttttgtctagttaacattaacttatgaaggtacaatttatattaaacaaaatgcagagatcttaaatattcagtatgttgagttttgacaatttcatgaacccatgtaatgaacacctacacaaaaaatataatatttttatcacactgtaaaatttcctaatatccctgtacagactatcttgtcagatgcagctgcttttgacttcaatcaaaattgcttagttttgcctgttcttggacttcaatagagtgtgtaccctttcctatctggcttcttttgctcaacttaatgttttttttgtttgtccttggtccatctattttattctgtttcattaatgtttttcagattccctttaacataatatggttttcatacctgtgttaaaaatcttgatttcattaaaaatcttgattccattttttatcacaaagactagatgattaatattaagggttactttctctgaataaataatagacaaattcatgtagataagtgtatttaaaataaaaaaagaattattactgttacagagaatgataaataactctatctttactaaaaactgaggagcaattaagcttaagttgaatatacatatgagcttatttatttatttatctatttatttatttttgagatgacgagtttcgctcttgttggccaggctggagtgcaatggcacaatctcggctcaccgcaacctccacctcctgggttcaagcaattctcctgcctcagcctcccaagtagctgggattacaggcatgcgccaccacgcctggctaattttgtgtttttagtagagacgtggtttctccatgttggacaggctagtctcaaactcccgacctcaggtgatccgcctgcctcggccttccaaagtgctgggattacaagcaaaagccactgtgcccggcccatatgagcttagaagttgttgaatatttgaatacttgaatgttgtaaaacagctaaaaaattgattcccacgtacatgcttaaagtaaaaagaaatgtattaatatgtgcttctttcacttcctttaatctccttatctctttctcttttttaactgtttcctgattctcagagagaatgtgcccatcctatggaagagaaaaatggggacaagtaagaggaactagagattagtcttacttctttctttaactttagattaagtgccagtactgcatattcaaagaaattccataaatggggatgctcctgaaggcccagtgatttttattccttgaaaagttgaagatatcgagttttgaactccatgatccatgtttctaaaccataatttatttcatattaaaaaatcacttaattatacctagaaattgtaaacaaaacacacaaaatatgtaaaaaaggatattcaactctataaggaatgtcagtgttatgcttctcatgaatactgtctgtgcttttagatttaccagaataattctgataaaaacagatgttcaaaatatatgtattaaatggaaggagatgatataaccacaatgaaatgtaaaagaatagcataaaactatgagaaatggatttggaaagcaaaaactcaaattagatagattcagaggtaatgttaatttcaccacaaagctgaagtctcaataatgttccactaattactgcctgtttataagtgtatctctacactttcatgtgtggagaaactcttggttttcaaatctgtcactatttccaaagcgtatttccaaaacaggaggattgcaaaaaaaaaaaaaaaaaaaaaaaaaatggctaaaacctgcactaagtattttaaaagtatcacctcctttaatcctcaatacaagtttatatcattatttattttgttatcatacttattttatggttacaaaattataggcttagaaagcttctgcctgatgttattattctaatacttggtgaataatctgaaatgatataatttagattatgtatctcattaaagataatttattttgggcccctaagaaaaatgttttgggttattttacagaaggagaaataaattcaacttaattataaaatatctcaaataatatatggcacagtgtcttgtttaaaagtattcattcttaaacactgtgcaatatgttatttgagaaatgttagaattcactattaatgaacttctgaaaaaatgagaaataaacaggaaaacaaaatgtggcacataacagaacccaagattcacagacaatctgaaaccatataatttagattatgtattaaagataaattattttgggccctaagaaaaatattttgggttattttacaaaaggagacataaaatcaaattagccagtacctgcattttaggaaactcttcttcaaataattattactgtcagaaaaaaattggttctcagcaagcaaattatttaataaatttccaaattcaccatgatttcagtgtgcaaacctttacattagtaatcaaatctctattgctagaacatgcctaaaccattgaaaagcattcaataagcgctcaaggagcaaagagaagaagaaatatagccaaccacagtaatttacactttcctcaattatatttcaaaaaataatatttcaacaatcactaataaaaatggtgggtaaaagttcaatgagaaacaggatagttacagtcttaacctagttccccacaatatagctttaatacttattaagtattaagtacaaaattactggtaaatacagaagggaaagctggaagacactgttttgtcaaagtgataaaagccatcactaccaataatgaaacagatacattgtgtgtcttttgtgttacatgctatgataaaaacagtatcatttttgaaacattcatgcacaaagtctacgaatcatgagaaaatatcaggtgaattaaaatttagagacattttatacactcctctggtcctgaaaaatattaaggtcatgaaagtcaaggaagtattgtggaaatgctaaaattgagactaaaaaaattgaaaactaaacttggttttaggaaatacacaataaagtagtaagggctgaagaagtttcatattttcaacttaattttcattagtataaaatagttatgtatttatatatgacatatagtatacattatatataattacatggtatatatacacttaatgtatgacatacttatatatacatataatatatgctgtatatttatcatacacacaaaaatctacctctatgtgactatttatcaattagtaagaggaaagaaatattgtctgaccagtgagtctcaatactgtcaaggtcatcaaaaacaaaaaaaaagcaaaaactatcacagtttagaggagactgaagaaacatggtaaataaaagtaattgttattctgtatggggacctggaatcaaacaggacattaggtaaaaagcttatccaccatgatcaagtgggattcatccccgggatgcaaggctggttcaatatacacaaatcaataaatgtaatcccccatataaacagaaccaaagacaaacaccacatgattatctcaatagatgcagaaaaggcctttgacaaaattcaacaacccttcatgctaaaaaatctcaataaattaggtattgatgggacttatctcaaaataataagagctatcaatgacaaacccacagccaatatcatactgaatgggcaaaaactggaagcattccctttgaaaatgggcacaagacagggatgccctctctcaccactcctattcaacatagtgttggaagttctggccagggcagttaggcaggagaaggaaataaagggtattcaattaggaaaagaggaagtcaaattgtccctgtttgcagatgatgacatgactgtatatctgaaaaccccactgtctcagcccaaaatctccttaagctgataagcaaattcagcaaagtctcaggatacaaaatcaatgtacaaaaatcacaagcattcttatacaccaataacagacaaatagagagccaaatcatgagtgatctcccattcacaactgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctatgaatgactttcttcacagaattggaaaaaactactttaaagttcatatgacaccaaaaaagagcctgcatcgccaagtcaatcctaagccaaaaccacaaagctggaggcatcacgctacctgacttcaaagtatactacaaggctacagtaaccaaaacagcatggtactggtaccaaaacagagatatagatcaatggaacagaacagagccctcagaaataacaccacatatctacaactatctgatctttgacaaacctgacaaaaacaagaaatggggaaaggattccctatttaataaatggtgctgggaaaactggctagccatatggagaaagctgaaactggatcccttccttacaccttatacaaaaattaattcaagatggattaaagacttaaacattagaccttaaacgataaaaaaccctagaagaaaacctaggcattaccattcaggacataggcgtgggcaaggacttcatgtctaaaacaccaaaagcaatggcaacaaaagctaaaattgacaaatgggatctaattaaactaaagagcttctgcacagcaaaagaaactaccatcagagtgaacaggcaacctacaaaatgggagaaagttttcgcaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaatgctcaccatcactggctatcagagaaatgcaactcaaaaccacaatgagataccatctcacacaagttagaatggcaatcattaaaagtcagggaacaacaaatgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactagaaatcatgctgctgtaaagacacatgcacatgtatgtttactgcagcactattcacaatagcaaagacttggaaccaacccaaatgtccaacagtgatagactggattaagaaaatgtggcacatatacaccatggaatactatgcagccataaaaaatgatgagttcatgtcctttgtagggacatggatgaaactggaaatcatcattctcagtaaactattgcaagaacaaaaaaccaaacaccgcatattctcattcataggtgggaattgaacaatgagaacacatggacacaggaaggggaacatcacactctggggactgttgtggggtggggggagggggagggatagcattaggagatatacctaatgctaaatgacgagttaatgggtgcagcacaccagcatggcacatgtgtacatatgtaactaacctgcacattgtgcacatgtaccctaaaacttaaagtataataaaaacaaaaaacaaaacacagggaattaaaaatgaataaatttggttctctatatatgtacatagtgctctaactttttaaagcttaaataaacctttaaaaaactaaaaaaaaacaaaaactaaaaccatctgaataagctatgaatttgaattaataatgtaccaatgttggtttattagttgttacaaaaaatgtactatattaatttaagaagttaacaatcagggaactgtatatgggacatatgagaactgtacacttctattaaaatatcacttaggtctaaattgttctcatattatttaaataaataatgtaaaatatagttgtaaatagaccatttccattaccattttcattataacaaagctcaagacttgaatatatcatttaatataagaaaaataatgtttaaatgtaatatagctttacttctattacatttaatttttataaatataatgcacattgaaccaattatttgtcaacaaatttaataagatatacttatagaatgaaacagagtaaacagagaggaagagatagattttcatgtttttctgtgctttcatttggctgaagtttggttttttgtgtgtctgctaattgataaaatcattaaaaatgtttttagtcattcctttaaaatttcaaagaaaagctaaaatatttaaaaactcattgtttaaaattaagagctaattgatgcagtaggtattgatgaaagatatgattatgtcatgttaggagaaacaagcataataatatttaaaataaattaatatgcaattactaattaaatcagcatgtaataccaggtaagaagaaatactgaaactggtctaatcatcccacagaactgatgtttatgttttcgtctgaataaacctagaaactgatgctcccagttctgaaacttgcaaaagttacatttgccctgtctgagttcctttcccaggaaaccaaccattagacctcccaggtagtatcaaggaactggagtttgccagatcgccacatcaggaaaatgagatgccagaccgcttacctgtcttgattgtctaaccaaccacctgcttcctattgaccttcatttcccctccctaattcccattttcccacatatgattacttttcttccctgctatataaaccggcaattttagtcagccaaagaaatgaatttgaggctaatctcccatctttttggctgaagcacctgattaaatccttcttttctggcaatgtttgttgcctcagtgattggctttctgtgtggtgagcggcaggacctagaccaaagccctggcattttggtaaaaattacctctatggtgagctaactattatgcatgtagttgggcagggtgttcatcttcatgggtcccatttcattaccttttagagttttttcataaatttgtgggattctatagaaaagttattaaaggttatatattcagtcaattataactttttataaccatataatcacatctgctttttcagccattgaattttgatcctacatcatcatcatcatcctatcattctattcttcatcctatagctattattttgtaagtaaggtcttttacagtgtcccctcatgatcaattaaagggcattttctggttgctactcttacaaagtttgaatagaataaaaatcagaacttgtgttgatttgaattgacaaatttatcatagggaaagtgcccatctgtgaatagaatgaagtttaaaagtatgtttattagtcttgctgttatatgggatttagcattcttcattttgtttggttataccactatgttaaccatttatttttcttatttcaaaaatataactagaaatataattagaattgacatgacatacagttattccataaaagaaggtggtaaaaacaaaaatacagttgtcccttgccatagccagattattagttctaggattcatgtatataccaaaatctgcacatactcaggtccctaattgaccctgtaaaacccacagaggtttcacatccatgaatattgtatttccatctatgcttagttgaaaaactgcatgtacaagtggaccctcacagttaaaattcgtgttgtccaagggtcaactgtaaagtttaataaaatatttcctcaaaaagaaatgcttcatggtgaaaataggtgtattttacttttagaataatattttaggaatcatgattggatgaaagcagaaactgctggatataattagaaagctcattgtcatcatcgttcctaccattcaatgagtgttatctattcattgcatgcacccagcaccataggtctcatgttacattctctgtatcctttaacctttaataactaccctaaaagtattatagttttttttaattgagaaaactaagtccattagaaattaattaattttccattattatacaggtaggaagtggtcatcctaaaactgaaacctatgctgtgtgactcaatagattattcccttttctcataacactgaaccttgaacatgattattttactaaactgaatcaagtgcaacttttctgaaattagtattaatatttattcatattaatggtcttacactctacactttcagattttaagactcgggaaataaatatgaattttcaaaatcgcatggaattttctctatgtactcaagccctatcagtctcttgcctaatgtatgtatacaatatggtgagcaagtgctcagttttggagtgagaatgttttggttactgacttagattggctacttatcagcagtgagatcttgagcaaattcattaatgcttccctatttctacactttctcatctgtaaaatgaaaacaatgaacacacaaagtttgagtctgtgggcagctatctataagtactaagtaagttatttcatggaaaacacttagaatttgcttggcacacaatgcaattaataaatggtaactcaatggtaattattataattcacttattattgtaaaatacctttatttcattcaaagtcaggaggtatgatatcagaaatgtggtaaacatatctatgcagtattcttattatgaacaaatttggataagaacaaatttaaaattggtctagtatgaaattagttcctaatgagtatgcctaatgacaaaaggagtaagaaaaataaacattaaaattattataaatctaaagtttgaagacatttaacctggtaagcaggacataattttctatatacttgttatgtcaatatttaccaaaaaacttgattctttcagaaactcaaggttatttaaactgctaatactcaccttcctaaattgtgaatggcattttaaatgtaaatttatgaagcatcctttaaaatttcatgttattaatactgaaagaaacagaacttgattaaacacaaattcattaagctgactgtgaagcacttgggaccctttgcgttgatccttatagagccgtgcgtctagaaaaacctttcaacgaaaagaaaaggtacatttggtcaaaggggaatcatattaatgttgcttaatcaatgagtttagtatttccgggacatgaaaagtagggtaaaaaaatctcaagtggcatgacagtcatataatgaataaatacataatttctctctaatgttttataaatagaccgtaattcatatagttcatatttatcaagttttaaaaagtgttttttgttgttcttgtcattattcttgttttaatctatgtaatttattataataatctggaaaggttatactcgtttctttaaaaaatttactctatatgagcttcttcataaatttaactcaaagcaaactcttgctttctatctcaggaacatcagcgtagaaatatatatgttataggatatttttctgtatgataactgtgccattcctaatttaatgataaacctacttatagtacttctgtaatgtgccaggcactgttctactcaatgaaaaacaaagtgccagctttaatgcagattcaattttaaaggggtagatatcataacaaaaagcaaatacatatgcagtattgttgcagataagtggtataaagataaccagcttcagatagtctgttacaagagtcataaaatatgcaggtcatttatcatacatggaaaagttgtggggcttttttctttctattttaaaatttattatgtgtcttcattgaaccttgtgaggcaaaaattctaatactaccattttcgttttcaggtgagaaatctgaagtacagaacaaattaaatgaaatgtttttaagaaagacaaatgaaactaacaaatggtaatccagcaccagcatcactgtatatttgtattgtcagcagatttagctactatggaaaatctttgaagaatctttctcaacatgatttttgatatacacatgctctaatttattgtgggtatattcaacagagtagaattgctgagtcatagggtgtctgcctgttcagtttttgttgacactacaaaataactaatgtaattgtgccaatttacttatctaccaacaatgtatgaaagttgtgattatccatatctctaccaaaacatgagagtatattttctttcaattcaaagtgtaattgaacttaaaataaataaatataattaaaactccattttggtaggtattataatccatggatggattacttttaaaaatttcattttttatttgttgctgatgtataaaatttatttcttttaaaaaatattggacggtcacagtggctcatgcctgtaatctcagcactttgggaggctgaggcaggcggatcacctgaggtcaggagttcgagaccagcctgaccaacatggagaaaacccatctctactaaaaatacaaaattagctgggtgtggtggcgcatgcctgtaattccagctactcgggaggctgaggcaggagaatcgcttgaaccctggaggcagaggttgtgctgagccaagatcgtgccattgcactccagcctgggcaaaaaagagcaaaactctgaaaaaaaaaaaaaaaattgaccttgtctgcagtaaacttgctgaactcactttttaactgtaattttttttttctgtaaatactgttgggtagttctatatataataatgccatttgtaagtatttaatttaatgccattttccaactataaggagcatttctagtttgtatttattgattttaagctcaattgtttgatgattagaaaacacattctgtataattttagccatgtgggggacatgttgatacatccgtgaaaacccagcatttggtaaattattttatatgttccatccatgtgcctgaaaagaataaacttcatagttgttggatacatcattttaaaatacatcaggtcaatttcgctgatttcaatgttcaaatcttatgtttccttgcttttttttctttacttattttgacagttactgagataacttttgcattagttttctattgctgtcataaaaattatcataaattttgtggcttaaattaatataatttactctcacacagtttggtcagtcagaagtcagagatagctctcaccaagctaaaatcaaaatgtctgtagcactgcatttctgtagactctgaaaatgaattcacttccaagctcattcagattattggctgtatttatttatttttatgttggtagctgtcgactggggttccttcaagagtattcttgcattttcaggctatattatagctccactggtgttcaaaaccagcaatagtggctaagtccttctaagtcttagattgtctttgatctccccttatgcctcatcttatccagttcctcttcccttgcctctctctgactctagccagagaaaattctttccttttaagggctcacactgagattgggcctaccagagtaatccaggataatctccctattaacttccataaccttaatcgcatctgcaaagctatttttgccaggtaagtgtacagatatctttgggaggctttaattcaaattatatgacctcccaaacatcaattttctaatttctaaaacagggatattccttccttgtaaagctactgtgaggactaaataagataatgtgcataaaaagagcttaccacagtgctcataatatagatatagctccataaacaatacattttaatttattttaatatactataggtaacccatgctttagaggtttttatagttccttcctgtctgcctcaggatggtaaaaataaataaatattgactgaaaaattttctctcaatgaaaagatcattaaaaaccagacatatataagctctatattaacttgagataaattcttcacatgaccaagaaaacattatgtctgccttgacttgctcttgtttacttacatcaaaataaattttggggggtgagatgaacctcaaaaacctgccatcactgtcgagaaagatttgtctccaaaacttgcataagaatgatcagcaactgtgtaattttttcttgaaaccaggcaaactatttacttaatgatacaattgtttaaagctaattgagtcttcacttaaagagagaaaactacttcaatgtcttatgtcttgctcatgagaaagacatttgaaaccttgttataacccgtgttcaacatgtagatagaggaattaataatgttttggtgaattcttgacaaactaatagaagaacatgtttacgaagagcgtaagagggtagcatttaatgcatttataaaagtgctgattgtgattatgatataataccataaatgtaaatcatatttatttgtaaaataaggtacatgaaagtagttataatttagaatactagaatgtttattgataagtagtgaggggatgattgacctaaggacttgagttttattcccaacttcgtggtcaattttgtaaccatcaatttatactactgctccagttctcagttttctcatggtgaataaaaagagtgactaatcaggactttaattttggaagcttcttttataaatctgtgataatgactttattatacctgtcttttgtattttaatgaagtgtgaaatattttgacattaacaatctattaaactgtgaacgatttttttggaaaaacatttagatctttcttaattgcataaacttcatgtcttatactaaaaggacaaatagtatgaaaaataccttgcaatcttgcacagaataaaactcatttcatttaattttattacaaacacagcattgtagatgggcaagatagggatatctatttatacacatacacatatatagtatgtatgtatctaattttaatgtatcttcctaatacataattcataatagataaaattcatgtcaactaaaccaatagataattcataatttataattcattggactaaactaagtactagtactatggaagaactattcaaatgaaaaatgagaataatagctaaatttctattttttttttgatgctatttcaagctttaaatgcactgttttttttttcaagaaagtaaatataaagagtatgggcaaaatcaaaggtgaaaaatatgaccatcaagtacacacatttgatattatcaaaccatagaagatatgaccatagtgtcaatgggataggatgacctcagttatctaaaaggaaatgcattgtgagaaacttaccagttcaacaatgtattgacagctttgcacagtaatatagcttctcaaaataatgtttaagatcaaatctttacctttcctataaattttatcactctgatgtttaggagtttagggtttgaagaaattgaagatcaatacatgtaaatattgattatttcataaaaataaatcaagtaaaagagatgaacaaaattttgagacttgcatggtagggaggatcttattctaggcaaaatgaacagtgtgagcaaaggctaagaaagggagatatttatgagatgtgagagagttaatctgaacaggataaggcattatcagggagaatttgagaatgttcagaatacattgacaaatggtcagattatggaaaagcttgaaggtctgccagaagaagtgaccttttgacacccgacaataatgagaaattgcaaaacttttgaaaagtagagttgcatgattaaaatgatatttgagaagttactgtttaacaagacactgaaaagattagagagggaagtggaaacagtcaaatcacataggatgctttgaacttcaaattgaacattataaatttctgaaagaaggatgaactatgaagagggatccaggggcagttagtgacatggatgaggctggaaaccgtcattctcagcaaactaacaagaacagaaaaccaaacaccacatgtcctcactcataagtgggagttgaacaatgagaacacctggacacagggaggaaaacatcacacaccggggcctgttgggggagtgagggggtaggagagggatagcattaggagaaatacctaatgtagatgatgggttgatgggtgcagcaaaccaccatggcacgtgtatacctatgtaacaaacctgcacattctgcacatgtatcccagaactaacatatatatatatgtgtatatatgtgtgtatatatatacatatatatatatagattctgtaagtagatttgttgcctaagataattcacctatcactttataccaaaaataaagttagcactcaaccgaacaaagcaaatgtaactcaaagggtgtatttcaaaataagatcatttatatataattaaaactagttacttggaaattaattagtatctgtcattacagtagaaactcattaaacaaaagtgactcaaagaggtgaagcatttatcgaccagtaattcgtcttgttaaatttaaataggagtttgtattttgtttttaagttatataatttagaaagtctcagattacaaggaacataatttcttcaaactttcatgaacacaagaatgttgaaataactaaaaaatatttttagtaacttcaaaaagaatctagaggttaaaggcccaaatgatctgtttaattcacaaattacagttattctcctgtaaagcaggcatgcaaatttttaagattaaaaaaaaatcttgaaatgaaaagatggtctggtaaaatatgtactatcacattaatgtcattcattttttcatgtgtctaacatacacataataggtcacattagaggtactctagaaatattttgtagcttaattaactaaaaataattaatacagtaaccacggtttaaaaaaaaataaaagtggttcttcacttatgcactttagccaaaagagaaaataaaacaaagcaaaacaacaaacaagcatgtccttaaaaagttacaatactactttttaaatataatttttctaatttgatcagcatttttctataagaattcggttgtgatttgtagttaatttttggatatttcagaacttgattttaaaatccagaaaataactttacatttatagaaccgcagacattttcttccagtatttaattagtatgaccacctcagaaatacaaaggcaatgtatttgtattagataaatgccttaggataataataataactcgtgttatgcctaagtaagcatgtagatggatctaggcaataaattttcaaagatgatgaaaaataaaatatctattattataaatacattatttttcccatagttaaatgaattcctaaaataacatcggaagtcacatacttcttctgagtactatttttttaatgttttcttgatatttctaaacagttaagctcataattttaaaggaatcatttataaacatttattgtatatagttagatacatatatcaacagaaaggacagagagagagtaaatagaaactgacctcattcactgtggcatagtagctttcatgcttgaaagtgggtgagttgtcattcctgtctctcaccactattcgcacttcatggtagataatagtgcccacttttttgttgatgcactggacctgcaccacaatggagtgtatgttcatcggtggctgcaatgtagaaattgcatcttttaaaatactaattaaaaacaaagcttctcatcactgtcaaagcactcgttcattcagtacatttttctattcttgtttatttttaaattataataatctcaaagaaaatgatcattttaaggacaagagaagacaatcataattaatttattgtttaattttgtatctcagcgtgtggaattcaggtagcattatgctcacagttagtggatggctaatgagcgcacccacaaaattaatgcttagaattgatgggattaaacgaagtttgcccctccaaagattaaagaagcaataatataaacttttaatttgaagaaagtgttaattaataaattcctggagaagagagattgtttaacttttatgtttatttatatttttgctggaatattatatgttcattgctgatcaaattaaaaatactgattaccaaaagagaaaatccaaaagccagccaactaaacttactcattctacacatttaaatgcttattttgctaatctttttcactctctaaatatgtacatattatagacacacagacacacagtgaatatcagcccatgtttataaatatagatttactatagcattttttgtataatactatgaagttatgttatgtgacagcaatattatacttcattgtaagcctatagcataatgtatccaagtaataatttaaaatgaactactccaggctattatattttgtcattataaaaaatacttcaatacatagtatacataagcatatgcttacttatctaataatttttataataaattccttgaacgggaaaggtcaaagatatacttcctcaagtgccatggctaacagtttgcagagctggaatgcacacctacaaatatttgactctagagtcagagtattgaccactacaaagtatttctttgtgatttttaaccccttttgagcttatgcaactttatctctaaatatgtcatttttgcagtgtcctatcctgacccctccatcttaaaaaccttgtctccaacctgacatctcctttcaaatttcttccaatttatttttctttattgcatttctcaccgaaaatttggctcgttgtatattttatgtacttgttttggtttgtctgccttcactagactggaagctcaatacaacctgtgtgttattttagtcatgatagtatccctctttccagtaaccagccctatgcctaagacagatgatctggagtcaaactgcatggcttccagttccataacctactaactgtatgatccaggaaaaagtacaaagtatctctatgcttcgtttattcatctataaaattaaggctaatagttacaccaatgagaattgtaaatactgcatgtgattagactatactaggcatatgttaaacacctaagggattacatacatatcctattttatttattaaaaaataaatatccaaaatagtgaaaaaataaaatctataatgcacgacacatttgtaaatgagaaaaatgctacagaaactatatctaagctgaaggaaatcattatttagtttcaagatatttttatggccaacaaagaaaaagaaagttgacttgaatttgtagctgtctgaatgatgctacctagaaagaataaattgaggcatcattgacatacgaaaagaggtctctagtgaaatcacacatagctctgtgtttttatatctactctatttctcctttaatcactgatataaatgaaggcattaaaatcatgtgtataaaatctgtgaatgttacaaaccttggaaggatgtataaatacatttaatgacaaaagacatggttcaaagtcatcttaataagtcataataatgggttacaaaatggtaaatttttgcaataataaattttatcctccaatttgtaatagaaaaaaaatcacccaaatgtaatagacagctacaaacattaatgtaaaaatgtaattgtgaaattttgatagctaaaagctgattttacatgacagcactgtaaatgggctactggaacactaatgcatactgtacattaattaataatatcagataataatatataggtagattataacaggtaccattttacaggtgcatagaagagaaatttgaacacttttgagaatgtataaaatgggaggattttaaatttaacaacatatgatttgtcaaatatctaaatggttgtcatggaaacatccattagttgacttactgtagtttcagagagcagaaataagaaaaatagttgaaaaatatttcaaagcatgttttcaccataagtagagggcttctcttaatccaaatttgcaccaaataattatgtgcctctatcaaagtatctcatgtaactcatatgcacctactatatacccataaaagtttttaaaaaataacaaatagagcagagattcttatcagtagaagagtatagtttatgttagaaataaatttatgccttcgcacttccaaatacttttcctctgccattatgagctaaaatatttgtgatgcttcaatttctttttttcacatttgtctttgtataaaataaagaaaaatcaggaggaaaaagtgacatggaatagaacagactattctataaaacaagacccatcactgaaatatgccagtttgaggataaaagaccattgaaaaagactagctcttagaagtttcctggaaagaatttgaattagatgacctccatttttactaccagctttcaagtgtgtaatagaccttttaaggcatgtccagcatattttaattgtaaattaaaaacaaaataaatatgtgtactgtttgtccttggcacacctcttggaagacaatgaggtgaattatgcacttttaaagttatttatcttccaattattgcaagagagacctataaaaacattctatctcaacttctaattctacttggagtggtaccactgggaccaaaaggtcaaaatcttatcaaatagaggatcaaatgcactgtgtactgaggcctcacttagtcctgctaagtacccataaattagatctaaccaggtcacctggaacagttatcactctcaactttagctccctatgcaactgttagtggcatggctagaacttagagggcaataaattataaccataatggatcacaccgaaggcaaaaattccctgtggctaatatataacacacaatgtaattttgtattggcatagattcaattctgctgtataagaaggtcatacataaaagtacagttctaataagtccattagtgagagtttagggactctaagatgcttaagaatgcattagggaaattttgctttatctttcataactggtggcaaaaataagccatggtaatttgaccttttctaattttctttaattgctttattcatcaaacaaagaagaaaaaaaagctaggtagaaattgtgttcatataactatttaaaactattaccattcatatatacctaaacatgcaagctattctttcaatttaaaaatgagtgcttaacacaatactctgaacgtatacttgcacatttgtgtattagtgtacctgtgtataggttatgatatgtgtatcaggaatgatatatatcaacaattaaaggatactatcattaaaaagtgggtttgagagtatgaagagaaaaaattttcccacaaaaatgtaaaaattttgtaactctgaaaaagaaaaaaatataaaatagaaatttttgttatgaatttctcaatcatttaggattcaacatgaaaattaaagtttttataggggatttgttgatattagcagtttagattatagcacaaatcttcaatccaatatattttttttctagaaaccaaatgatttggaagtcaatgatttggggggcagggaatgcatttttggcaaatctgtaggaatttatttttcataaagtataggcaaagtttgtctaattctcaggagtgaattttttttgtcatgatatttctgtctatggacttaccacctttataacataatcattcctatttcacaagtaatgtggaagacagtgaaaggaaataagacactgtgtgttttagaaacgacttttacataaaaaagcaaacttaaaggaaatggctggccagagttgtcagtgtccttcacaaattaaattttcacaatgaatagtagcatatttactgaagatattacctaaaaagaaaatatcaatttgtaaatacaattatgcatatgtgacatgtagatacatctatagatttttcacagtgaattattaaggacattcagtctatttaatggtaggtatttgttatatgaaaagtttaatgtgggttaggattaatatgacttagtccttggatactaatagcaacttttataaaactgatatgaggtgatcataaataaagtcagtcaaaaatactattaaataatatggattttagaacaaggaattgcataccagtgttattagaaaataatttatacagaagcagcatttaagatatctcttagtagcacataaaattcaactgatagcactggataacagtgatttcaaagtttatgttcaaaagaacatcagggaaggtatggtaagaaaaaattggatatggtcatgggacaataattacattagttttcttagtttgtagttcatacatttctaaataaaaagaaaattatatagacagggtgcatcttgaatctagcaaaactcaagagacagatagaaaacagtttgcaatgaaaaggtatctgtgggcacagtctctgtttcagcactctggttgtagaataggttgaatcaagacaggtggtagacaacaattagtttatatgagtgatgactaagaggtcttatactaaagttatgttgactgatggagatgcaagatacaaggtggagataaaactactaaacttagcagttgaatggacactggcctgggcaggggagtcaagccccttttgcagctaccaagttagagtctgaaagaaaagaagctaagatatttgatgttgttatgaacataatttctctcgtttcaaaagcttttaaaattttgcccaggattttgagataagtattataggactgtaccagagtcatacttttctttctgttattattttaattattgatattgtcatgaccattattatcacatgcccaatagtgatgagagcattttggccatgtgagacaatcatttagcatttcaaaatttttatgtgatgtgcctttattactgagactcttcatgttcaccccaaatatcacattctggttgtttctcttttgtgacttttaattttgtaactcttcctttctttttttaatttttgggtgctgaaaatttatgtaactttagtgaacaaaaaaataaaaataagacataaaaataaatgatgaccataagggaaaatcttataaaccaagttttaaaattataaaacagttcatagtcatacaatctcatgtaaatgctttctaattaaatacaaatatctgagcgttgggtatttttattctttatattcttcctcggaaattttcatgaagatcatgtttatcagcttatttttaacacactgttaaaaatgtttctgtctatattgtttgcttttaattctattacagccataattattcaaacgtccccattaagagacagtttattgcctcaatgagaaaatgtagaaaacatgatttgcatcactttctctggaaaataaatttttctctaactgttgctaaaaagatggtataattggatatggatctaccatgtggccctactccttgctccctggctatagattcaaaccagtgagtatttaattgttatttctctcagaaattttaaaacaaaacaaaacacagtgactttaagccttctttaatggccactgcatcaaaagtttatgaagaactggcatggcatgaacacagaaaacacttaaagtcaaatgaaaaacaaggaagtggagtaaaattataagtgtataaaggaatctgctctgcagagagaaaaatagagaatatgcacagagaaaggcagaaactagagaccatatggtccaagaccaagtagttttcctctctccctggtaaacatacaatttccataaaagtaaattattttttatatctatgctattggtattgttaatattctctcccatcagctggaaatcatttgaaggcattgttgtgtcttccttataagccaaataactttgattaaaatcagaatattcttagaaaagcataatttcataacaaaaattcagtggaaaattttctataaaaataatttcaagagcaatttaccactaagaagggttaaagttaattataggctagtgattataatacaaagctttcgccattgttagtaggatcaaactcaaattgttggttctattttgatattcagagcatatatatatatatttgaaatggaatatatatatataatatataaataaaaatatatttttgaaatggaatatatatatataatatataaataaaaatatatttttgaaacggaatatatatatatatataattttttttctttttgagacggagtcacactctgtcacacaggctggagtgcagtggtgtgatcttggttcactgcaacctccgcctcctgggatcaagtgattcttctgcctcagcctctacagtagctgggattacagggtacctgccacaatgcctggataagttttggactttagtacagacgggttttcaccgtgttggccaggctggtcttgaactcctgacctcaagtgattaactggccttggcctcccaaagtgctgggattacaggcatgagccatcacacccagcccatattttttattttgattcattatattcataaaagaacaaccaaaaaactttgggcaacaatcaaaagaattacattttaggtaaatgccctatattttaaaagaaactacaaatattttggtatttatcataataatatagttatttaataataatgtatattttatctatatttagcttttgggaaaaaacattttacattaaataaaatttaaaacagtgtaaataaaggtatatatatttacatatatgaatatcatagtattaatatatatttcattaatactggagagcatattttcaaatacaatctatataaaaagtgtgcactcactttttttaaaatgaattctctactatatctttgtagaaaatattaactaggatcatagagaagcatacagaagaaaaaatatcttattctatatcaatgtaaataatgttaaaacaataaagtaaaaacatacaacacctctccaagtaaactaagattatttcaaatatttacataatattattattttatttcagacattacaattatttagcaatattggtatggaagcatatagggacaatatatcgagaggaccatttagtaaaatggataaaactccctagtccagtaatataatgatggtaaatgaatttatctctataaaacaactaaacaattgtagaaagatgcatgtacaaaaattttcactgcagcatttttgtaattcttaaaaactgcaaacaaacttgacttccaaaataggagattcattttttaaaaatctcttatttattcatgcaataaccaatcatgcagctaataaaaataattatataaatatacatttgtttgcattataattttacatgtattataaattttatgtaaaaagtaggccgacagcaaaatgaacagcataatccaatttaaattaataagtattataaatatacatatcaacacacataaatgcttgaaataaaatgtggcagaataaacattaaatgttattttccctaactgataaaattatcttcatatatatgcttcttattttctgatatgtttaccataagcatatattattttacaattaaatgagactgtaatttccagtagtgattagatttggactaaaagcccagatttacctcactatttgtctagcagtaatggtctataggacacataaaacagatgggcactaggttaaggatattcagaataaaagcccttatgctttgatgaatgaacccctaaaagcactgtggcagcaggaaaacataattcacaagaattcaaagaattcataagtaataaagcacatagtaaactgtagtaaaataagaggcaaattgagatttattaaagactccaaattttagacatgaaatagtataaagtatcaaccactccataacctattgtaaagtggatcataaaccctgagcaatgatgtgaaatgattcaggttcactaagctgagtatctgacatttggatttcataagctgggaacttgtgggtaagcatgtttagagttactctctgagttttcccagggcccagtgcaattactgattataatccactaccctctgcccctctgtactcaagaaagactgagatgcaaataagtgagtacaaagttactttagagagctacttatacctattaatttttttttaatttttccagaaatgaaacatccaactacgttggtaatttagcaatttttttttgaggtagtgtctcgctctgctgtcctggctggagtgcattggtgtgatcatagttcactgcagcctccactccccaaccccaagctcaagggatcctcccaccacagtctgcagattagtgggactacaggcacgtgttaccatgcctgcctagtttttcaaattttttgtcaagacagagtcttactctatttgccaggctggactcaaactcctgggctcaagcagttctccccactgggcctcccaaagtgctgggattacaggtatgagctactgctgtgccaagcccaatatagatattcttaataaaaaaaaatttatgctatctgagaactacttgactggcatattaccatgaaactttttctcattttttttttcttttttgcaactatgtaagacatttccacagttttgcccttcaaccaatgcttactagttgtaaaagcaggctcctgtgagtgcacccaccaaactacatcttcaagccggcagctgagtgacacacttacatgttgccattgttggacagaaatgagttatagccatgcttgtcctactttgccaagggtaccacctcttttttctaagcactatattttcttcttgttcagaaattgacaagcttccaggatattaaaggggaagtctaacggttctccaggacacagatgttcccttcctttctcattcttctttaaatgagttaaagaaactgttgttgctatactcaggaaataaactcaaattatgtaaataattcaatatcatataaacacacacatagacatttaaattataataaacttatattacaggggcaaagaaaaaaaatcactaacatctctatccagaactcttccggtgctgttcaggaaaagcatttgcttaacaggatccatcaacacccagtaatccacattatcctttaaagaaagttctatggtggggtctggtcctccagcagtccctttgatcagcatgttgtccaccagaattgtacctgcaaaccaaagaaaggtacttgaaaacatattctactcatatgaattctttagcaaagatcatgctcttaaaccgcggctggctcacaatcagttttaaagctgaaaatactcaactgtatatctagcataagacagaaaatattctttaccaaaaggccaaagtatctgcattatattatttataaataatatttttggtggaaggcagagatacagacatggtgagttccatcatccattttgtgtttccctctaacaacataaatctgtttccccccatctatcacttctcacaggagttatcactgaattttatcctgaacaaaaggaaatgcctgtaatagcagagtctgatgtctcaattaattctgttagacctctgatgtgaaaaaaagatattgtgaaactaagaaaggaagaggaaatagatttttaaaaagtagctgagcctcccatggtgagaactgcttctttttatcttagagcaaatacataaaacatacatcttgacatgaaagacaaaactagtgtgcagaaatggaatagaagccattcttctttaagacatgtctgggttactctactagaacaacgcactaggccagtgtaacatttcagtgattgctttcttattattttttttcagcaagctgaattgtagacagtttttgaataaaacttgaaaagattatgtctctaaccctttctactgtgttaaagatcccatgcattttacatgtcgaatgcaaacagcactgatgcaactcaaataccatttttccctcacgcagcaatgatctctttgccaaataataatgtaccatggcttagagcaatcattttcaaccgatccattttattaaacttatagatatagaagagatgtggctatgcaagtaaaatgtagcctccaaaaaaacactagaataaatggcaactatcgagagaacacatcgccttaggacagcactcaagaatatacagagaatccataaatacgaatctggcttgaaaaatataacgaaaaaagtatctgttgcattttcttaaggcatgaaattggcctaaatgttataccgttgcataattacaagaaaagtggaaggctctttaaaatattttctcagtaatttaataataactataattatctataatatttctttatcatactactactaccagtctttatccgcctaagaaatgctggaaagaaccatgaatcttttgtaacaagccagaataatgtttaaacacaaatgttgtctcacatacacatacttttgtaaatggcacattttttgcactttttcacatactaggacataattacatgaatattgagtggaatgagtatttttatttttgactgaaatggcaaatacacaacctacatacaatacactccaaagtatagatcagatattgatggcattttattgcctataaatatgttcaagaatgtatatatattcaaggccccagtacatactaatttacaaatacttcacacaactcaccatgaaaagatatttgatctgtatttcaatatataattgagaaattgaaagggaatttattttctcatcaagaaaacttatgtacaataggcaggtcaactaacattaacattaataccttgactcaatagtgtttaagagtagcaactgcaaatcttctgattgtgtgtatgcatgtatatatatatatatatatatatatatgctccatatatatatgctccatatatatatgctccatatatatatatatatatatatatatatatatatatatatatgctccaagctgcgagcagatacactaagggaaggagccattgaactatctttacaaagcaaatagtttataaccagataaagttttaatagtaactaatattaaagtagtgaaacaaaaacactgtatctggatttatattttatttaaagattctaactttcatggaaaagatctatagttttcttgctctcagctcactcctgagttcaatgattgaaactcaacaaaaaatctttctactgctggtgtgttgaaagagttttgtttgcttgcctgctttcccctttagaattgtccatttgtattgccaaaaagaaaaaaaaaagcctctcaaattttcatatacaagcttgctttaagccaaaatttaggggagagagagagaagagagcaaagcttaggcagacatgatacaaggagcaatatacatattttttaaaaattaacctaagtgttcactctgaattgcctgaacaactgtgcccatacccctctccttagaagaatacgtgacacccaagctatagttagcattaagccagaaactcctgtctctccctatcccagcagtggtgactgtatctttccacacatcctaagttttcaagatctgaaaagctagtgttctagacaatattggcaagcagctaaacaccagaatactctgggtgtattgggataatgtgctctctttcctccttcgttactttgcaagcttccctttttgccaataaaccttttgcttaatgtgtttcatttgatgtttaaatgtattctcttctttgacttcattttaaatattacagataagttaaaaataaaaagatgggaggcacgacacaacactaaataagaaaactggatggctctattaatgtcagctagaacaagcaatgtttaatagtggtaacgagacatatttaattataataaagggatcaacaggaataatcctgagtaggcctgtcttgcagaataggtaatacccaagatgggattcaccttacatgaaattttcctttcatcataataaaaatggtggcagttcagaaaatggaattaaatttagtttgatactcatataatagaagttaagagagctggccctggaatggataggcttagaatccaatccataatccaccacttaccaactatgtgaaagtggataaccgcatttaccctcgatttttctccctacaaaatcagtactataagagaaaaggcatttctactataatactatatgtatgttcctgaaaaagacttgttctcttgtatttagaataataaaaatcaaaacaatcacaatcgtgttaaaaatattagcacagttaaatatttattgacattttcaacacatttcttggctggtcaatcttttacagccttaaatactgggatttgtgcttcatcctttaagaagtaggtattgagggccatttacctctagggacgttttttataaaaatggaaaacttcctctttcatttagcctctttattagcctattaattcagaaaaataactttgcagcttctttttatgtacttcctgattctcaagagagattaacatattaaattacaggagttcatgtaactgctaatatagactctatttgtacagaataaatgttcttcaatagattttccattttttcttaagatcttctcacatagctagccctttctttttaattgtgacattagagcttgccacccatacaagaggatagtgggcattaagtatggtccaaaaaacctgtgacatgcttctaccccaaagaaaagtctatgtttctatttcccatgtatatgattatgtggttacataacatgagattctatgttgtatacatgtgtctatgtgtctgtataacatgagaacacaaactgtgttgtgttctgagtccataaggaatacataacaacctgattgaacttggaagcaaatgcttccctaaccatgtttcagatgaaatggtagccctgacaattccttgattatactcttgtgaaaccttaagcagagtacctggctatgctgtgtctggactcctgactcaaagaaactatcaaataataaatgtgtgttgttttaaattacctaattttaatgatattgttatacaataacaggtaatttacacaggatttaatgtcaaaagatctatgttcagaatcttggccgcacactattaactaactgtgagcttaagcaagttcccaagatttttacaatcagcaatatagagttctatgagaaaacaataaaaatgaatgtaagtggaggcacgcaactacccaatgaataacatttttcatcctacagctactagcaatttatatagatttgagcatataaaggagttatatattatttttcattaaattgggaacattatcaacaaaatgattttaaatgtaaaatgtactttctgtacaactgaaataagagaagcacagaacatacttaaataccagcaagaaaaaaaaaagactatgtatgcatatgtaaaatataaaacaaaaagaaggcaacagtttattcacagtaaccgttgataacttttcatgaaataaaaggccatttcttgctggcaaaagcaaaaatgaacaagataataagcaaaaaaagtcatactactaagatcaaaaatgcttattagtacttattagcatttgctgactgtattaactggactaagagataaaatagaaagacgttcagggaattaccatatttaattatcagactggtgtaaatgggaaaggtttataccctcagaatattgcaatattttattattttcaggccatcaaattgctgcagttaaaattaaaagtacaagcataccatgccgtgtatgtgtgtttttgtgtgtgtgtgtgtgtgtgtgtgtgtgtgtgtgtttcaacataatgattaaagtgggtaaaaaacaatcttcataccccactctcctcaaccaaaaaaaaaaagaagagtatagaatctaatcaggcagttctgttcattagaaaaatatgtcccaggggttgaaatcaaagaaacaaatattggttattttattttattttatttttgagagagtcttgctctgttgcccaggctggagtgcagtggcgcaatctcggctcactgcaacctctgtttcctgggctcaagcgattctcgtgactcagcctccataatagctgggattacaggcacctgccaccacaaacagttaattttttttttttttttttttttttttttagtggagatggggttccgccatgttggccaggctggtcttaaacttctgacttcaggtgatccatccgcctcggcctcccaacgtgctgggattacaggcgtgagctactgcatccagccaaaaatatggttttaaaatgtatgtgaaagattgatttgaaaagataaaagccaaaaaagccctgcttgatgaaaaagctcaacctcttaacctgtgtctccattagaatcaattataaacctcaaattttgggtttttcttccattccctaaccaaacaattaaatctctaccaagctgaagatccccccccttttttttttttaactaaaacttcatttcaacttgtgaaattcctttttttagtgaaaatgcaactgtagaaagttgttgttgttgttagatatgtgatttaaaatataaactttttgactgcgattttaaacactatttcaaagttttaaatgattcgattcagtaaatttgtaagtgtgatttattagattgaaagaattgattaagtgtcttaagaaaaaaatcctcttgggtatgcttgcctacccttctagatgtttgaagagtttgtattaaatttatcaacatcacagtagtttaattattaaagattgcatatatagtactttggataggggaagtaagtttgttaagcttatgagttaatagaactttaatcacagaacaaattaaagttttttcccttagtttttcagtcttcctacggttatagcaggaatgaaaatatttacgttatatttatggtcaaatacgattttgattttatctgtgtcatttacacatatttaatattagttaaaactcaagcaatattccatgaaaagacaacccacatattcaaaaaataaacaaaaacacctaattgactgtaggacaacaaacaattatataagacaatatgtttaagaaatggatgtggaattaactggtagtagtgaatcaatgaacatatttcaacaactccatttatttcattttttgagtttctggttgatccaaatccaagtgtatattccaggcagagagaaaggtcacatcataatcctcctccatttctcctctgatttcagatttaatttttaatataagatatttaaaaccttttattccatagataaatttgtacaatagaaaatgtggttttttagtacctctaggagaattctgagttgtcataaccctacagttaaatctgttttctcacctataaaatcattcagattaacaattctgtaaacaataaggcaaaattatttaatatgttattgaaaataataaaacagatggatgttatgacaatactaaatgtgaattagaactatgttacagaaaaatgttttgtttctataggtaatttgcttctggaaacaattaattggaggacatatttaataaccatacgtgctcaagcagtttgcttttttcatgtaaaagtgggcaagtattaagactaaattctgtcatttttttctatggcagtgcctatcgtagaaaaacaaataagcttaagtttgataattaaagcagcaaaaatgtaattaactaaagagtactcaaatattcaaagttttctgataggcttatcatttgagaggttaatccagccaaacaaatttaatttaaagtactctctaactgcaaatgaagtaaactttctaagtcatattccttttcaatagcacaagtacttgccctttttaaaaaatcaaataaactaactaaattaaataagattctttcaggtattttctaaaggtcattttattcatttggtctgtaagatgatgaaaatcattttacacattgaagaagctatttcaaagcctgacgaagtactttactttcaaaaatattttctaataatcattgcataaatgtttcacctccttggttaaattgattcctttgtgttttattctttttgatgctattgtaaactgaactattctcttaatgtcttttttagcttattacttgttaggtatacaagtacaactgatttttgtgcattggttttgtatcctactactttgctgaatttagttattagttgtgtgtgtgtgtgtgtgtgtgtgtgtgtgtgtgtgtgtgtgtagactctttagggcagggatgtccaatattttggcttccctaggccacagtgaaagaagaattgttttgggccacacaggtaatacactaacactagcgacagctgatagctgatgagttacaaaaaaaaaaaaatcccaaaaaataatcttatgctgttttcagaaagtttataaatttttgttgggccacattcaaagttgtcctaggctgcatgtggcctgcggatcataggttggacaagcttgctttagggttttctatatgcagtgtatttaagaaagaggaagattgtttaacttcatataataataatcagatacttgaatatgttttattatttatacataatattattcaaatattaatcagagaaccacctgaaagtgattatctactttctcaacataactttttcccactataaacattcattgttatgcagaatatataaagaacttctgaaatccaacgaaaaacaaatgatctgattgaaaagtgtgtaaagaacttgaatcaatagtttttcaaagaagatatacaaataatcaataaacacacagaaagatggtgaacatcactaatcattggggaaataaaaatgaaagctacaataataaaccacctcacattcattaggatggctactagacaaaaaacctaaaaaatagcaagtgttggcgaggatgtggagaaattgaaacactacaatgttggttggaaagtaaggtggtgcagcccaaaatttcagttacacaaaagaaacaagttcaagagattaattttacatcccagtaactatagttaataacaatatattgtacacttgaaaattgctaagagagtagattttaagtgttgtctgtacaagaagtgaggtaatacatatgttagttggcttgatttaaccattctacaatgcatacacatatcaaatatcatgttttacaaaagaaatatatacaatttttattaataaattgaaagtttaaaataaaatcatatggaaattgtggaaaacaaatgtttcctcaaaaattaaaaacagtattaccacgtgattcagccattttacttctgagtatatactcaaaagacttgaaagcagtctctggaagaggtacttacatacccatgttcctggcagcatcattcacaatagctaaaacttggaagcaaattaagcatccatccatggataaatcaataaacaaaatgtagtatatacacaaaaggaatattattcagccttgaaaaagaaggaaattctgacacatgctacaacatggatcaacagtgaggctggtatgctaagttaaataagccactcatgaaaaaacaaatatggcatgattatacttgaaactgacccaatacttccatatattttttaataaacatagatgtgtactcttctgatctgaaagtttgaaatttaccaaatgatcttcaggcctctcaaagtatcaaaaaactcaccatatcaccacatccagacaatgagatgcaggatccctcattcattatgcttgcttccttgcccctctgtaattcctgtttcttgcacattattgcatttcttccctgctatataaacccctagttttagtcagtgagggagataaatttgagacagctcccatctcctcggcagtatcacctgattaaagccttcttccttggcaatattcatcgtctcagtgattgagtttgtgtggcaaacagcaggacctagaccaaatccctggtgttttggtaacacacttatatggggtacttaaagtagtcaaaatcattgacaaagtaggttgttaccaaggacttggggagggagtaatggggagttattgattaatggtatagagttttagttttacaagatgaatacagttctggaaatggatagtggtaatggctgcacaactgtatgaatatacttaataccactgaactgtacactcagatatgtttacatctgttcctcttgcttcacttgtccttatcgtatttgctacaaggcattaggatcaattatcccccacaagtatggaaagtcttttctctgttcaaacgttcatcagcatgaagggtccaaaaatggccagaggacaatctgagcttccaattagtcagaacaatagttgagtttcgttgtcaaagcgttcaacttctggtcctagaacccaaatgtcacccagctgaaggtcacagacaagaaagccaaaattattcacgaagatcattaagtaagataggaagagagatcactttcatcttcacttcaagttgcccaggctctgttatgtcatgccatctcctgcatagctattcaggagagggcatgccttcgtgacctctaatttaaagcatacgccacatactgtaagagaatgaccaaacctcatagaagttcatcttctactagccgttatctgagaattaagaattctatcccaccatcttcttctgctagctgcttctgaatggtaggcattgtagtaacattattggattaagctgtggtgtgagctctttgctatgatccttcaccttaaaataaaataaatcaccttgttggaaatgaggttgtatgtccaccagataatgatcaaaagcattggaaagacgttctctgagcacatgaatgttgtttcaggtagaaggtctacagacaacacaaatccatactgaatcatatttatccatataaggaccctcctccatgataaaagtgggtttaatgccactggtcagtgagctggttccctgaggaatgataccataatagggattcagatttgggttctattactggcacattgagtatcagcaacagaagtaaccagattagccttagtaatgctatcttcttgagcccacatattaatcccatttaggtcactatgagcactttacacacagggtcatttatttatccctattgagaccaggaagcccattctgttacagcgtccctcactgacatccctaatctacagaggaaaaaaaaacaaaacaaaacaaaaaaaaactgtagggctcttcaaggaagccagatgcccttttaccaatatacttgttaaatcttgctgaagtgcatgtcctctggttatcttagaagtgtatagataaaggctggtttatcagattacacatgaagataaattcattgcacatttccatcactctgaacttttaaactcctctaaaatagggcttctcaattttaatgtgcccatgaatcacctagagatcttgttagaattataacttatgatttagtagatatagagtaggagggtagagccgtctagttgatgctgcttgtctgtgtgtctcactttatgaaagcaggctttatcacaatgtttctaaagtgtggtcccctgacataagtatcatcttcacacgagaacttgttcgaaatccgtatttgcggctccatcccaaactattgcattagaaactcagagatcccatttcagcaatctgtgtttaaatagccatccatgaggctgggaatggtggctcacgcctgtaatcccagcactttgggaggccgaggcgggtggatcacttgaagtcaggagttcaaaaccagcctggcaaacatggtgaaacaccatctctaataaaaatacaaaaaaaaaaaaaaaaaattaaccaggcatggtggtgggcgcctgtaatcccagctacttgggaggctaagggaagaaaatctctggagcccaggaggcagaggttgcagatcgtgccattgcactccagcctgggcgacagagtgagactccgtcttaaaataaaataaaataaaatagccatccatatcattctgatgcttgttgaaatttgagaaccttgttttataatgtgctgtaaaagttcagacattttgacttcattaactataagctattattgagacttggtttcagttagccaatctagcagactattaacgccacttttcattgtggtagccaaaacatcacaccctgaattcagggtgaatgcattcatgcaaaagaattcagcttcagcaagttttgtattttgttgtccattgtctaacgtctttagaattcactcccatgcatgatttctagctccctgccaatagtgacaatgacctataccttttgttttgttttgttttgttttgttttgagacagtctcgttctgtcgcccaggctggagtgcagtggtgcgatctcggctccctgcaacctctgcctctggggttcacgccattcttctgcctcagcctcctgaggagctgggactacagctgcccaccaccacgcccggctaatttttttgtatgtttttagtagagacagggtttcaccatgttagccaggatgatctctatctcctgacctcgtggtccacccacctcggactcccaaagtgctgggattacaggcgtgagccaccgtgcccagccaacctatacctgttttgtagtataggctatcttgttttaaaaaagatcttatattcctgtcttgactaaaagctaacatttcttatggccctagaatcaatgagagatggtataagtgggtcatgaaaagaattgacattagctcttgaggaaactgtccaaatatagttactgtaaggctattaggcagaagaggactagagaaagtgagagggtctatgttcactagccagaaagttcatgaaattgagatattcaatgttttcaccattatcattttcccatctcatgtctcaatgtcccttttcttccccagtgccaattttcagtgccttttctataggttaagaggatcaaaagggttgagagttccaagtatgttgcatctctgcaacacttataatcataaaaagatgggctccttcaaagctgccctgatgaccttctgtttccccatgtgctcttattgcattttatacctgttagtttacattttccctatatacattctcaagtatatagagaatatacacttggttgtcatgagaaaccaaatgtaataataattacaactattgctacagtgagtaattgctgcagccacttgatcatccaatactctatacctgcactcatcccatgccaccacaggtgtcatttgagtaattgtgatgccacacctggcaaaaattagccacatgctatgtgaatctcccacctccacgaaaggagtttatgcatggatccttaatatgcacactccaatccaagaatctcattttgagttattttttttttcttagagacaagtcaagcaccaattactataatacttggtgtaccagcaagaaaatgtcaccctcaaatttagataaaccaatgtgtttttagtaaaggaaagcttaagagaggtgtgagtagggtataggggaactataagaggtaatgtcatacactgacaaacaaggaatacagaagaaaaatttcatcaggaaaaaaaaaaaacaacataatctaatggggaaatgtcatataacatgagccatgtttagaaaagaaggcagccagcttggagagaacctatgcaacacatacctggctattatttacctctttcccttcatattctcctttctttgcccatttgtggaagccaactgaatgtcagatggctcaggagccttctgatgcaatccatgcatctctgagaaggtgaagagtggatgtaaaaggcaaacagatgtatctgcacattacctcctcaaggcattgtcttctgaattggtcttgtcaagagaatctcaatcaacaatgggatatagattcgggagaaattgagaggaaatttatgagttaaagcttaagtgattggcttaggaaagcaagtgccatatagtgtgaggcataataacactgtggtactggacattgtttagttgtagtttcctttatgtgtctgtataaaatcaacttttagttatataatttgctctatagtacaggtactttgtttcaatctctctctttccactataagaattgcatacacatttgaaagctagtttaatttaaaaaaaagtactaatttggccgggcatggcggcttacacctgtaatcacaacactttgggaggctgaggcaggtggatctcctgaggccaggagttcaaggtcagtctggtcaacatggcgaaacccatctgtacttaaaatacaaaaaaatttggtaggcatggtggtgggcgcctgtgatcccagctacttgggaggctgaggcagaaaaatcacttgaacccaggaggactatgttgcagtcaggctagattgtgccactgcactccagcctggcttgggtgacagagtgaggctgtctcaaaaaaaaaaaaaaaaaaaaaaaaagaaatgtattaatttattagcttttattgtgagtaatgaaagattatacttctgtccttagatcatattgatagtatttataacgttacataattctatattttgctccaaaaaaaaatctgtggccaggcacgctggctcatgcttgtaatcccagcactttgggaggctgaggtgggaggatcacttaaggtcaggagtttgagaccagcctggccaacatagtgaaaccctgtctctactaaaaatacaaaaattagctgggcatggtggtgcgttcctgtagtctcagatactcgagagtctgaggcagaaaaatcgcttgaaccctggaagtggaggttgtagtgagccgtgattatgccactgaactccagtctgggcgacagagcaagactcaggctcaaaaaaaaaaaaaaaaaaaattgcattgctgcaacatgagaaagctgctcctctagtcagagtatggctaagggaagtacatcataacttttaatcactgatatgtgattaaaattttaaagttttgataacattttaattaatgatttaagatgtttggctaatttccatctgaatttagattcaagcactttgcaagcctgttttaatctctatgcttaaaaaatctacatattaataaaatcagccttactacatacaagctgtcaacaaactctgttctaaacacagtggtggtatgaagtcaagtacctttctagctaatggtagtcagcttacacagttgttcaatggggcaacacaatcatatctccaactgttacagagattgaaatgattatcatctgaactactgcacttgtggcaaagttttctttctcaagaaggtttttggtaaaatacagatctatcaacaggagataccattacatttttagcacttaccatatcatttgcagagggatagactcagaatatgatagttgccatgaaaaatagtgaacagtaaaaactgaactaaatggaatatagaacacaagtattggaatgggaggcaaacgttaagaggaagagatatgggaaaatatatcaactcattattcaagcttatttaagcttcatttacatcacaaaaagtttccattcacaaccttttcaaataaaactgaaaggtttccatgatattttaaaaatataatctgtattttatcttaacaagaacttggaacaatattctatccaccattcctgatccaaacaagtgcccaatcttcatctatcttgcctcatattttcagtataaagagcccattcactttttagggaaaaaagacacaaataacacaatggcacaattgttaagtttctcattatatacaaccctatagctaataatgcacatgtcatttccatttctaggttgactaattttgatgggcagaagtgctctaaagtatgcttttataaacctcatatcacgtggtactccatggctgaaacatggcttaatgcatgttttaggatggtgaaggaaggagagaagggaaaaagaaaagacgaagaaaagaagaaagaaaaaggaaggtgaaggaaagaaagagagatgaagaaagaaaatgaaaatatgaccatgttataaagaaaattgaaaacatataattattttttcttaattttagcctgtgtagaaactcttaaggctgatgatgagatagatattttttgccataaattacatgaatctattcatttttacattcttattatatagcattagaatatgttgcattatatgtagactccttagaagatacacgtaaataaaattatcggggaacctgccccgatattcatgtaggttcttttctgtttttcctaagcatctgccagcttgagaagtaaagggacagagtacaaaagagaaaaattttaaacctgggcgtccaggggagacatcacatgtcggtacgttccgtgatgccccacaagccacaaaaaccagcaagtttttattagggagtttcaaaaggggagggagtgtgcgaataggtgtgggtcacagacatcaagtactttacaaggtaatagaatatcacaaggcaagtggaggcagggcaagatcacaggaccgcaggaccgaggtgaaattaaaattgctaatgaagtttcgggcaccattgtcattgataacatcttatcaggagacagggttttgagatcaactggtctgaccaaaatttattaggcaggaatttcctcttcctaataagcctgggagcgctatggaagactggggtctatttcatccctgcagcctcaaccctaagaggcaggcgcacctgggggcgctgtttataagcctatacctccaggtgggtattctctttcccaggaatgtttcatgctgagaaaaagaattcagtgatatttctcccatttgcttttgaaagaagagaaatatggctctgttctgcccagctcaccggtggtcagagtttaaggttatctctcttattccccgaacaattgctgttatcctgttcttttttcgaggtgcccacatttcatattgctcaaacacacatgctgtacaatttgtgcagttaatgcaattattacagggtcctgaggctgtaattacatcctcctcagctgacaggattaagagattaaagtaaagacaggcataggaaatcacaagggtattcattggggaagtgataagtgtccatgaaatctttacaatttatgtttagagactgcagtaaagacaggcataagaaattataaaagtattaatttggggaactaataaatgtccatgaaatcttcacaatctacgttcttctgccatggcttcagcaggtccctccgtttggggtccctgacttcccgcaacataaaataaaaaaaaaaaaagatgctttcaacttagtgactattattcctgtctatctctatgtgcatgtattacacacacacacacacacacccacattaagaacccactaaatattgttaagttcttggaaaatatgaccttaagtgaaatgacatacaataggtccttgaataacatagtcatttagatataattataatacgcaaaaaatggattttgttatgcatcgttttgattaaagtcacagtttccaagaacctactgatgacattaagtttatacacacacaaacatgcacacacacaaacacacacacacacctacacacacaaaggtagttatacacaatatactgactgccttataagaatgttttttctatcttgtaataatacatgagtaccacatttttcaatgcatttaatcatgctgtatctgagaatgtgacttattaagtcccataaatatatctaatacattttagagtataaatgttcaatgtattattgtagatataatatgaaactgtgcatgggagtggagtgaggaataattgaagaaaaggctcttgctgaaccaatttacctatgggagatcagaatatgccaccccaatttaggatggtttggcataaggtttgttgagctgaaggcaattaagaagcagatgaagaaaagctctctgcctctatttacctaaaaggacgatatacatttacaaagacaaaaaatatcccccttcccctctaaaccggggaggacaaatgttatccactgaagagaactttagactgttatgggcctggagatggcaccagaggaatctacattaacaagctttacttagcctttatctgccttttctttgccttgcctcaagttgctgtctttagaaattcaaaatccttttcctttgtcatgtcgcttccctaaaactttactgttctttgttgaacaatgcgttatataagctgaaattcaaactcacctccttggcggctactcattcccttgctgtcttccatgtatatatgaaatacacgtcaataaacttctctggcttttctcttgttaatctctcttttggtccatgggtccattccaactaatactttatcagaattgaggaaaaaaatattattcctcttccaaatagctatttagtattttctggctgacagagcaagtgtcttgacagagaactcacatttcattctctttccaacactcttcttttgatacactttaattataatccttaaaaatcagtctctgtgttagaagttgacatgatatatgaaggaaaagggccactttttaattctggaagttaatgcaataacataaagtagaaaaatagcatattttgaaatatatttcatgtcaaacacagacatatccttctaaaatgcagcatcaggaaatacttaggcataataacaaaagttcaaactatgatttcaaaacagagaatttgacaattcaagtatggatatgataagcctttattctgatttttttccaaatattccgacagtggaaaatgttcaaacaaaatttgaaggaggaggactgtgtactatcttattttccctcaatatttttcttatatactttaaagtaattttattctgcaatattgtgtcgaactatgaatttctcaaccattgtttctgaattgcaataaagtcaaaccgagcaagatggctttaatattgccctcatcttgacgaaactttaaacacttttcttcctgactgcatgtcctgacctttattttcttagagtgtttacttcagaaaattttccattgtaaattcttcctatgactctttgagatgtaaatagtctcccagccacttgtgagttttataacccagggatgtcttaaaaaacttggagacatccctttgaaatattgttatccagaaagatattttcccagtctcccagtttgtatggataataggagcctaaattccataagcaacaattaaacaattaaatgtggtccaaactcagggaacaaccttcccttcacttcctccaatgcttttccactaaaattttcttgcattgtgtttcaaaagaactgagttcaatttctatccactattgcaatagccttgaataaagtcttgcctgtttaactctatctggtataatttttcttcaagagaaccttaattagtcaagttctattttggcaatgggattcatattggaacttaattttatattataaaaatggataaataatcacaaacataaaatatgaatatatgtttccaacaacattgtgtgcatcaaaccaggcactaaatggcaaaggtataaataatcataataacaacttttgtggtgatagagttttttctagatgcactagatatgctgatattcttaaaataaaaattcttacatattagccaaaagatacttctgccagacaaatgttttattcattattacaaggattctagaccttttaaaattaagatattctgtttcaaagtcaatgtacaaattcccctaagttcttaaaaaataggggcaggtttcatggtgacctgttcaaagatctattgctgagatagattttagtaaatcaatttggttcactatcccagttggtcacaaatatgagtttttgttattacttcaattatcttattcattgcttactcaaaataccttttaagtcttatcccatgcagagatcagatggtaaggtttttaaagtaactatatgactatcagacttatttccatgtaacttgctttatttttgcctgtctttaagattttattacataaaaagtaataaaaattaattttaatgtattcctaaaatttcaaaatcttgcttgtttaaaaaaaaattagtcttaattaaaaaaacactatggaagaaaataagcctttaagtgatctatattatcctaatgatgttgttatgttacttaaatcaaaatttgtgaaaaaaataggttcacacttctgaatctcaaataaactttatagatcaaaaattaccaccaaaggtgctcagaaacaatgactaaaatttccatctctagcaattttttatataacaaaattgtcctaacaatactagctaataaattagagtttggttacaaaatgaaccatgataaaatctatcacagcaggaaaattttagaaaaggtcaagaccacttatgtgatcttaccttcaattttagaccaaggaaagtttgtaagtgaaatttaacccttcaaaaatgccccccaacatagtatcttattcttgtgcaacctggaaaaacaaaaaaaactgatattagaacctaggttattttatttgctgctggattatttgcttatttgttgttttaaatcagaaaaaaaaccccaaatattctggtagcctagaaataatcaatagccttgcagacaaccaagtatccgggttgccttatgaactaagcataggatagaattaaactagacactgctaaaatgaatggacaatttttagtggtatgtatacaaaccttaaagttcaaataatgtaaatggccgacatcaaacatattttctaaactatagaattttacaccaaacagtatgttctgccacagtaaactgtctctggctttcttaaaagtgatttattttatactgcaaattattctgtcatgtccacttggcatatatgtgttcctttctgattttctcaacaactctctcttagaaggaaagcattttctttttagaaaccattttgaatacataatcacatacatgtaacagaacatttaaaaagaaactgtttcagccaaaactatgctacctactctcagtgaagagagttgcagacaacttttgtaggacatggaaaagaagccactgaagttcagtgtgtaacatttatatgattaaatataatataaatataaataatataatgattaaagatgggaggctcaggtagcttggacactgaggatttgggaggaaagcaatattacagtgtgataattgcaagttatcaacaaagagtcatcagacttcttgcatttctccataagcttgatgacaagaacatcaggtgggtttctctgaaaagaactaaatttacagaagttagagaatttagagaaattagttgaagggtgtctgactttcacttgacaattttaaagggtgaaagtctaaatgaagaacttttgcagattaatggtctgcggttaggaaataactgtattccaactagagatgagtctcaagtgagtatttcccaccagcaaatgtgggccatgcaagagagtagacaagaaggagatgatctcaagcccagcccaagagaatcaccatgaggaatgaggagacctcagcagtaagacgctgggctgtgcagccacatccgcgggaacagcaaaagttagtgaccagaagacaaattctccagccatcccaggaattgccagaaacagctatccaaatttggaggtctccaaagaatctgcctacgtggttcacaatctcaggagttgccaaaatcagacctagagagtacagcaatgcaccctttcttttctttttacctctaatgctttttccagggtcaaacctggaggagatgaaaatcagtatttagtaagttgaagaaacagagatgaataaggcagagagagagcaaggttgttgacacccaggttctaaggcagctgggatgcctacaaaaggatatccaagcggaaaaaaattgaagtagatttctagccaaacttagaagtcctctgtgtctaatgtatttcagagtaggagataaagtatttgttggattagcacattagcaaaattatctagagaaaggaatacatgtgtaatgtccaataaaagccagtgattctccaattgaacataaaatggactaagttgataagaaatgtggggctctttcaacaaatagtttaaaatcaaaatcatgaaggtggataaaatatttctttacccccagaaaataaacggataaagctacttctactatctttgttatttttcactctactagccctaattatttcattactaacttatcatcaattgaaagttataaaatgcatgtttccatcatgatactatgtcatatatattttaaaagatggttataaaagtcatctgtcattattaaattaaattttgagtcaatatatatttgtattgggctatgaatatgcataagaaattaatattctgaataatatgtactctttcagtgccctggaaaagacaataggagcctgatacaatttgtcattcttgcacagtgacagttaatcgaaaattattaattcattatcaaagtatcatttccatgacaaagacgagaggaaaacatgcagactgtgtccagatttcttccagatatctaccagcaaaatatcaccaaaattaaacaatgaaagatagacgaaaagagaaaaaagccagagggagaggagagagaaagagagagaatgattatgttttacataaaaaacagtaaattgaattccttacttgatttttataggtattgttcatctagtttgtagtaaagggaacatagctatagacaggaaactgtcattgttgagaatttggagcttaaaagtattcagtaattttaaatgcaggacatgtattttcgaaaccattcataattaagaaattaaaaagattttagtaacatttgtgaaaaacagaaagaaaattatttaaaagtctttgctcttcagagatagtgcctggctcttgtagattcctttcacctctacactatgctaaaacctggctttgtctaaaaacaactttagctatagatggtcactttctgtaaaggcttttctttgttattgtcatagcattacagaatattgatgacttcaatatcacctacacagaaaaactgtatatgacttttggaaaaaaaatgagagatttagggcaagcaaagttatgctgttgtagattcaaaaaaaaaattgacattttaggttaagtatattttcaatgtttcaattataactgtaaatctataaatgctggtagaggtaacctcattagaaataactccttattctaagagcaaagagaaacctgaaatgctaaaatggatactcattcttaataggatcaagaaacaccaaatacccgtcaaatatccgaagattatattcaatgactctgaacaaggaaaaaagcaaaaaattaagtgaaacatgaatgaaagaaattacagaaatctaaacaaaggtataatctatattaatggattgtaaaactcagtagcttaaggatgctaaaatctcctcatgtaatgtcaataaaaatttcatcaattttgaataaattgaagaattaagtctaaaacatatacaattcaaattacaaagtatatgcccataatttatgactttactgcttaattctaccagcatataaagaagaacacatcttaaacaaactattacaaaaaataataggaaacacatactattttggtttttgatgctagcataaccctgataacaaacctgacaaaaatacatcaaagaataaaaagtacacatgaatatcctcattaacacagatacaaaaatacttaatgaatttatttagaaaataaatcaaatccagcaatctataaaataatgcattatgaccaagttggttttaccaagaatgcatggttggtttaatgtataaaatacataaaatcttattaacagagtgagggaaaaaaacataactcaaacaacacagaaaattcatgtatcaaaagtaaacgtgttcaagataaaaaatattaagcaaattaggaatagaaagtaacttcctcaatctgataagcaaaatatttacattaaagaaaacagaactaaattaaagctgacgggaagaagaaggcaagattatacaatcttataatttctattcatcatggtagttggaattcctagccactgaaataaagcaaggatcaatgacatatattaacaacaaagaagaactatgctcctatttagaaacagcatgatcgtttatgtataaaatattaaatacagataggccaccttttattgctttctttattagtttattgaactccataaatacggcatttttttaaaagtttgaagatttgtggcagtccttcaaataaatagcaaatttattagccattttttccatgtgctcacatcatgtctgtgtgtcacagtttggtaattcatgcaatatttcaaattttttcattgttatatctgttatgattatctgtaatcagtggtttttactattaattactattataattattttgggatgccgcaaaccattcccacattacattgaacttaattcatgaaatgttttgtgtgttctgattgctccacctactggccattctcccatctttctccatctcttcaggcctctgtattccttaagacacaacaatattaaaattagaccaattaataaccctacaatggcttctaagggttcaagtgaaagagttgcacatctctcaccttaaatcaaaaactagaaattattgagcttaatgaggaaggcatgttgtaaccaagataggctgaacgctagacatcgtgcatccaacagttagccaagctatgaattcaaagaaaaacttcttaagggaaactaaaagtgctattctagtgaatgcacaaatgataagaaagccaaaaaaccttattggtgataagtagaaagtttgagtgatctgaatagaagatcaaacaagacacaatattttcttaagccaaaacaaaatccagagcaaggacctagctctctacatagctatgaaggctgagagaggtgaggaagccacagaagaaaaattggaatcttgtagatgttggttcataaggcttaaggaaataagccatctccataacacaaaagtacaaggtaaagcagcaaccacatgattacatcaatagatgcaggaaaggctttcgataaaattcaacacacattcatgtcaaaaactctcaaaaaagttaggtattgaaggaatagaccttgaactaataagagccatatatgaaaaactcacagccaacattatactgaattggcaaaagctggagtatttcccttgaaaaccggcacaggacaaagataccccctatcaccactcctattcaacatagtattggaagttctggccagagcactcaggcaagggaaagaaaaaggggcatccaaataggaagagaggaagtcaaactacccctgctagcacaagacatgaacttatattcagaaaccctcaaaatctaggcccataagatccttaaattgataaacaacttcagcaagtctcaggatacaaaatcaacgtacaaaaatcactagcactcctggacaccaataacattcaaggatccaaatcaggaaatcaatcccattcataactgccacacactcacacacacacacacaaacacacacacaaacacacacacacctagaaatataattaaacaggaaggtgaaagatctctaccaaagaactacaaaacactacttaaagaaatcagagatgatacaaacaaatggaaaacattccatgctagtgaatagaaagtattatttttgctaaaatacctataatatccaaagtaattcatagattcaatgttatttctattaaactaccaatgacattcttcacagaactagaaaaggctattttaatattcatattataaatattcatatttattaatgataaaatattctattttaatattaatattcaggccccaaaaaaggacctgaatagccaaggcattcctaagcaaaaaatacagagctggaagcatctggctacccaacttcaaattatactacagggctacagtaaccaaaacagcatggtactggtacaaaaacatgcacatagaccaatggaatagaacagagaacccagaaacaaggtcacatgcctccaactatctgatctttgacaaagctgacaaaaacaatcaatggggaaaggactccctatttagtaaatgtgtagggagaactgacaagccatatgcagaagattaaaactagaccccttccttataccatatacaaaaatgaactcaagatgcattaaagacttaaatgtaaaaccaaaaactataaaaacccatttctctggacacaggaacaggcaaagatggcatgaccaagatgccaaaagcaactgcaacaaaagtagaatttgacaaacgggatctaattaagctaaacaggttctgtacaacaaaagaaaccatcaacagagtgaacagacaaacctacagaatgggagaaaattcttacaaactatgcatttgacaaaggtctaatattcagcaactaaaaggaatttaagcaaatttttaaggaaaaaaaccattaaaaagtgggcaaaggacatgaatagacacttttcaaaacaaaacatacatatgagcaacaagcgtatggaaaaaaatctcaacatccctaatcattagagaaatccaagtcaaaaccacaataagataccatctcgcaccagtcaaaatggctattattacaattaaaaaagtcaaaaaatagcagatgccagtgaggttgcagaaaaaaagcaatgcttatacactgctggtgggagtggaaattagtccaaccactgtggaagagagtgtggtgattcctcacggacctgagaacagaaataccatccgaccctgcaatcccattactgagtttatacctgagggaataaaaattgctctatcacaaagatacatgcatgtaaatgttcattgtgtcactattcacagtagcaaagacatggaatcaacttaaatgcccatcaatggttgaatggataaagaaaatgtggtacataaaccaaacttggaatgcggtacattccatgtgtaccacatggaatactatgcagccatataaaggatgagatcatgtcttttgcacgaacatggatagagctggaggtagttatccttggcaaacaaatgcaggaacagaaaaccaaatactgtatgttctcacttataagtgggatattaatgatgataacatgtggacacatagaggggaacaaaacacactgaggcctattgaagggtggagggtgggaggagggtgaggatcaggaagaataactagtaggtactaggcttaatgtctgagtgatgaaataatctgtacaaccaacccccatgacacaagtttacctacataacaaacatggacatgtactcctgaacataaaataaaagttaaattaaaaaaaaaaactaaaaattacatgcaatatttgtagtggtacaaatatatttatgtaactgtaaaaaagagagatgtataagaatatatacaaaatgtaataatggttacttccaaacaatacatgaaggctagaagttgaggtgttttttttttaatctgtaaggttttaattcttttaaaaaagaaaaagtattagtgtattgtttcacaatttttaaaaaatgtacaagaatgttcttatttctaccatattggtctgcttctttgtattttttctggcccaacccaaatcagtcttttcaaagtttatctacattggttagagatggagccttatagaacattgaattaaaggcagacatccaaacagttattgtatggaacagatctgcgtactaaatatgaatgtgtgtattgtgtgtgggcttatagtattaacaatacacattatgtctttttgttttttatgtgtattgtctgtgtacctgtgaatttcagtattcgtgagctatgcattaatgtataccacagttaaataaatgaattagttgcagaaaaaggaagatcaaagttggaaggctttatctatctgattttaagatgtactaaaaagccacagaaataaataaataaatgaataaataaataaataaatggactagaataggtaggaattagtcaactttatccttaagggccagatattaaatatttcaggccttgtgggacacatatgaggtgtctgtcactttttgcccctcttcctcctcctttctcctcttctgcctctttttctacctcttattttgacaatactttaaagatgccaaaattgttattagattgtgagccacataaaaacagcccaggagtcataatttggcaatttttggaacaaaggcaaaaaacagaaccgcagtagcctttccactaacacttcacaggaatttgatggatcaggaaaaacctttgtaacacatgatgctaggacaactgggtatccatatgaaaaacaaaagttaaccttaacccctacctcctaacaaacacgaaattaatcaaagaaggagcaaacgtaagagtaaaaggccaaactacaaagtatttagaagaaaacaggggattatcttcataacctgctatgaaacaacacagtaagaaacaaccataaaagacaactttaatatattagagtttcttaaaaatttaaaacttttattcttcaaaagatacctctacattaattataaactggaagaaaaatatttgcagaacttgtgtctaacaaacacttgtatgccaaatacacaaaactctatgacaactcaataacataaggacaaattttaaagtggacaaaacacttgaaagaaacttcctgaaggaatgtgcatgaataagtaataattacatgaagtgctcaatatccactgataaaaatttcttaaataggcaaaatgaatctatagtgatagaaaacaaatcagtggttgcttggggaaaaggatggagaaaattgattggaaaagagtacctgggaactctttagagtatttaaatgttttataccttgtcagagtggcagttacatgtgtgtatatacttttcaaagctgtatagttaacgttggtatatttcattgatttcaatgtaggtaaatctaacctcaaatatccataaatataataatcatatggaaggtcacttccaaattggtggaggaatagttgaaaaaatagtctaatattatcattttttaatctggataatggctccaggatagtttgttatggcattcaatttattctgtatatgactgaaattttaaaactcttaagctaaaaagcatttgtcacatgtttttgctgaaatattggttccttgtaatttctcacttaattcaagcagacatctaaaggtgatttattttccacccagaaaactaagagtacaaggattcacttgtgtccacaagggaatcaagtgatccaggagaacgtgcttcactattttttgcttttcctgacccttaaacagcttctaattcctcttgctaaaaaaggaaaagggatggctgggcgtggtggctcccacctataatcccagcactttgggaggataaggcgggtggatcacttgaggtcaggagttccagaccagcctggccaatatggcaatacctcgtctctactaaaaatatacaaattagtcggggtggtggctcactctcgtaatcccagctactagggtggctgaggcatgagaatcacttgaacccgggaggtggaggttgcagtgagtggagatcatgtccctgaactccagcctgggtgacagaatgagactctgtcaaaaaaaaaaaaaaaaaaggaaaaggaagcaaagaaaatagaaaagttacttcctctaaggtaaccctaggagttttcttcactatatttaggaacataattagctgtttttttaaaaaaaaaaaattgatgcatgcttgctttctctctatatagaactatattttgcagaagtgttaatgatgttttgaaggtgacaatgttatcccacaacatataatttcctctcttaaaagtactatctttgaaatgggctcacataatatgtaaatatatggggataaatgtatagtctcattacaaactataagaattattccatatatgtaaaatatgaactactataattgggtgtaaaaccaaggttgtaaatttaattttaataatttgcctataatatttatcagtccaaagtgatttgaaaagaaaatctattaacatgttttacaatattcttacattatttctatcattatgtatgagacaaatcatgatgtgacagcatgtgacaagtgtagcagatgctgtggatcagcttacacaaaacttattccaactacctcctttgcacatgtttctgaaccgcataactgagaagctaaaattatacttaaaggattcaattgcagctatgattctatgtatgattggggttactctgacaagattattttttatataagacattgttcagaatgtactatgaaggggacaggtgttacactttttgcagttacaaatcggggtggaagtgctgtggttctggtgttagctgtggttctgtagttggcaatgttggcatcagctttctggaaccaggcatctggatcatgggaaaggcagcatttcctaggtgatatggcttggctatgtccccactaaaatctcatctcaaattgtagctcccataattccctcatgttgtgagagggacccagtgggagataattgaatcatgggggcagtttctcccacagtattctcatggtagtgaataagtctcatgagctctgatggttttataaggggaaacccctttcacctggctctcattgccttgtctgccaccatgtgagacatgtattttgcgttttgccatgattgtaaggcctccccagccaggtggacctgtgagcccattaaacttctttcttttgtaaatcgtccagtctcaggtatgtctttgtcagcagtgtgaaaatggccaaatatactatagcagatcagttatgttgtggttttgcatctcattcctggcaggtcaaaacagaatctatttcttccaccctttcaatcatatgtgaactatttatgccacttaataagtcccttcagcttgaagaagctagggtatattgttttttgtaactaatatccctaactgatattgcagacttcacataaaaacatcctgttgaagatgaggaactagaagattctttccccagggacatatgatattaaaaaaaagctacaggtagctggtctttactgtgtacattatcaacctcttacccaaaatactatagtggtattcactgctataactatttacagtatattcagctgttttcttacagtcttagcaaaaccatcttctcatctgttatgacttgcatgtaccccccaaattttgtgtattggaaactaaatgcccaaactcatatgttgatgatatttggaggtggggcctttggaggaggtaatcaagattagataaggtctttagagttagtcccccatgttgagactggtggctttagaagaaaagaaagatgtgagctgacttgggtgctcttgccctctcactatgtgctgccctctcaccatgtatgatacagcaataaaaccctcaccagatgccgatgccatactcttggacttccaagcctccagaaccataagaaatattttttttctttattaattacccagtccacagtattctgttacagcaacagaaaagcaattaagacaccatctcacacctggttttgtctataccttgtgagaacctcacaactgtaattcttctgtataacacatcaattaaaatagaatctagacaaaatgtcagtattaaaacaatcaggaaaacagggctgggttgataataaggccacaatatttgctgcctctgagaatttgggaagggatggatttgaagaagaagttttctgcttgcatatctagttcttattcatatgcacacaagcctaaggggaaaaattcaggctcatcgtccttttgattgcttaaaagcatgtagcagcttccaatttacctttcctaaagaacaagtcaggctgcagaaagatcatggttttgaattcagccatggcttttaatttatttcttttagactttgcttgactggaaagctctggaagctggggttcaaaggcaattgtgtttaaagaaaatacttagttgggaatattctaacagcaactgatgggtttaataattcttgtagatactatataaaattttgaatagctagtatttaggtaaataattgcaaagaaacactcttcttttggaataaattacatggagtcctgttgctgtctacttgcaaataatctcattcacgttttgatgaaactcacaatgtacacattttctgaggaaaatggaaacaggaggcctcctgaagatacaataagatgattatatttattttcaaacctttaaggaaagctcctgcaagttaggctaaaatgtaaattttagtgaggattctattagaagttccaaggcaacagttactttcaaaaatgatagacccactgtgagcaaaagagagaagataaggactctgaccgagctggcattgttgaataaggggccctgatttgctgctcaatagctgactctgcaggtttcaattataggaatagctggaataatactgctctacaatattactggtagaatttgcaaagaattgatatatagagtttaagtatgtgtctctgtatgtgtgtttgtgtgtgtgcatgtgcagcacacagacatgcattatgaaaagggagttattcaagtaaaaagcacctgccgctaccataacaggtatgatctaggctgacccatgatgcttgggtgggtggtgggacattaagaatagaacatttaactacaggcatgcttatattccagttatatataggcccactgcacctctaaattgttgcactagagtctttattttggctggatttaaaggccacttcccaaaatttgtgcagaatctttgtagttacataattaaaaattgaaagaatttaaaaaatgacaactgtagtctcactgactttttaaaataaaattaaaagaccagtataactgtaagcccttgttcagaaaaatgttaattccttacgatctagactcagaatgtggggtttgaatcacaattctatcagtcactagcaatgtgatcctgagaagattacttagtctctctgtcccacagtgcctggtttataaactgggaataatatttattttaaaggattaaatgataagctacagatatgtctttttgcagtgtgactagaaaatagtaaacacgtaataagtgctggttgctgctaccataatgatcagtgtatttctatattgtttatttctggatatcagtacttttgatataagactagacagtgaattcctcaattacaggggctatgtctccagtaaacaagaaaatgcctgtcacacagcactcacattaaaagcttagttgaattgatacaacttgtcagagagactaatactgagggcacgatggccttatcatcagcatatcctcattactttgactagattatttaatttattctcttttactccttcttacttctacttcagttaaaggcaactggggagtatagaaatttgaatatttagctttttggggctatgtccgtagtttattcactacttagggtgacctgtgcacatgctaaatgattaaagaaggcaaattctaggatggtaagtagagaaatgtgcattatagattgaaggcatgtgatgggcaaaagagcctgaggaactgacaatagatggaggaactgacaatagatggaggtcagtaaacaaactgaaaaacaaatgtaagggaaaacatctgataaaattaaaaaataaatatcttatttaaaaatatacatcttcttaaatatatatttatattttaatatatatttaaaattatatatatgttaagtaaaacagaagttactaaaggaacttccacctttgtatgtttgcttgaatattacatctttaaaatagcttttgcaagagatgtttcacaaaagaagttgatcttacaggtattgtagttttctctaaaatgcctaaagattaatactccgcaaagtatttcagtcaatttcaagttggggaatttggatgaccaagacatctctgttctctcaattcctcagaggacatacaccgaagttagttgtgatagtagttattatgcctattaagggtgagatccttccaggttctaacttctattgtcctcaaacacagcactctgaaattctagcattaatgactgttactggctacttacaacaagcaacttcacttggatctaccatccagtttccaagctaccaacattaccttgttgcattgtttttgttgctgttgtttctttttttgcgacagagtctcgctctgtagccagggtggagggcagtggcgtgaccccggctcactgcaatctccgcttccctggttcaagggattctcctgcctcagcctcctgagtagctgggattaaaggcatgagccaccacgcctggccattacattgtttatgtacaagctagatgataaggaccaggcaacacttgtgctatcatattgcatgtgtgcaaggctacacagcctgttgatgcacacaggagagactaagaaaggcagacctggccatggcctacctacttgcttactgaactttgtattccacgaaagaagggagcatgaacatatgtttagcaggaaacttaaagtctagcaaatttcctggcccatagtattgtattctagttgtttgttaaataaatgaatggtctgtatacaatatagcatctctctctctctcaacgaatagcaaaattttttaatagacaagtaacgaagggccttccaatttaatgataataatacatggttggctatctattacagctctttgtgattgttggtttgtgaatctgaaggcactatttctcaaagtgaagtccaggaaccacttgatcaaaggtcatctgagttgctgtttaaaatttcagattcctggggtcacttcctgcatctccacctctgacaacaatattcaggaaactatataatcaacagtctaccaaggtgattttatgtacactactatttcaaaaccttagtgctagctcattctctaggtgaacaaatgaaacaagtataaatatgataaaaagtaagagatctattgatcatatttctacatgaagagattttctatttcagaaattgaagtaatcagctttttaaaaaagcctttttgggaatcaatgtaagtttcataattcagccagctgaccaataaatattaaaaaatgtttaactttcttatatttcatcatttaaaaaaatgagaaattattccatagtctatgtctgtctgtatacattattcagctcccacttataagtgagaacatgcggtattagactttctgtttctgagttatttcacatacgataatggcctacaattgcaataatagacattggagacttagaagaatgggagggtgggaggagggtactggatgagagactgcttaatgggtacaatgtacactatttgggtgatgattacactggacatttggtaatcatcacccaaatcattacccaaatagtgtacgttgtacccataaagcaatctctcagcctctcactactacacaatatatacatatgacaaaacaacacttgtaccccttaaatttacacaaataaaacactacaaaagaaaattgaagaatgatcctatttataatagtgacatgaactaatttgaaaccatgtactcataggagatataagaagaaacaataacatgtcctagaaggccaaaaactgaagacttgaatcaaatgaaagacatatcattatcttgaatgagaagattgaatattacaaacgtgttcatttactcgaatctacaaacttaacattaatctacaaaattaacataattccaatcaaacatttttggagggttttggacctggcatgtttacatgacggaataaatgtgaataatcaccaggtaactctataaaaagaaagttattaagacagagttctcctataatgaatgacaaacataatattgggctacagaacagaagtaggtatacaaatatggaagaatatattacatttattttgaaattaaatttttgataaagttagaattttcagtcagtgaatacttgatactttatttaaaacacagttgtcaactttttactatacgtcaggctatatgaaaatattaactgatttaagtctctttacaatcttacaaagacttacaagttaaaaattttaaatttataattttagatacatgccattatcagcattatataacacatgagaaaacgaagcccagagagtttatgtcacttgctgaaagcaacagcaatagtaagtagtagagccaggttgtctgaatgttctttaataccatgatataagatttaggctggcacttgaagaaaaagaattaaaatcatactagagttcttattttaaaagcagattaaaaatagaattttatttcatttaaatgaacaacataaaaccaggaacgtattagaaaaaaaattggtaagtatttgcatcaattgatgtggtaaaacgtgaaatgtgatatcaagttacataaaggaaaaatattcaaccagaaataccatttcacatagaaatgtttaaaatgtttcatatttcacatagaaatatttaaaatctatacctctaaagtatttatgaaaaaattcaaaatatgataagaaagtacattgtggtatatgtttaaattgtggtaatatgtttgtttttttcctattgtcacagcttaattattgataaggtctttatccacaaaaggggttcaaactgtgcaatacatttttgtcacactaattacaaaggttagtattactatgaaacaaaagtttcaagatcaattaaaaaatatggatgttccaagaaaaattgaagaaatttttaaaaatagtcaatagtttaaaaaaatcagacagagaaggaggtaataaaaagagagaagtactaaagtaagtaacaagagaagaaaaaaaggtagaaagaagaaaataaatattccatgttgtcaagaaggcaggagattctcaaattttagcaatgggattatttgaaagtaatttagaaaatagttaagtatttatgcaaaattattttaaataatattcacagatgtgatatatgtgaaaagaaaatagttgaacataatcaaaaaaattcaaagattataaaatgtattattacaatctatataccacatattatattggccactagggatgatataaaggtaaatttagtgtgacagacaaacaatgaaaatattagaaatggtagaaaggtgactttattgacataaacaaaaatgacaaaatgagaaataaaatgggaaatgttgtatgatctcgattgggtaaaagacaatttatctacatgtgattttcccatacaaatcatttgatccaaatggtatttccaatgacaactgaaaatataaagtgaatttaaggaggtgaataggtataatattttttaaaaaatcgacttttttattttttaaagacaggttctcacttggatgcccaggctggagtgcagtagtgtgatcacagctcactacagcattgacctccctggcgcaggtgattctcccacctcagcctccagagtagctgggactacaggcacatgccaccatgccaagctaaatatatatatacacataaaatttttaaaatttttactttaagttctgggatacatgtgcaaaacgtgcaggtttgttacagaagtatacgtgtgccatggtggtttgctgcacctattgacccgtcctttaagttgcctctcctagctccccaccccccaaaaggccctgatgtgtgttgttcccatccctgtgtccacgtgttctcattgttcaacccccacttatgagtgagaacatgcagtgtttggttttctgttcctgtgttagtttgttgggcatgatatcttcgagcttcatccatgtccctgcaaaggacatgatctcattcttttttatggctgtgtagtattccttggtgtatatgtaccacattttcattagccagtctatcactgatagacatttgggtttgttccatgactttgctattgtaaatagtgctgcaataaacatacatgtgcatttgtctttatagtagaatgatttatattcctttgggtatatacctagtaatgatattgttgggtcaaatggtatttctggttctagatccttgatgaatcaccatactgtcttccacaatggctgaactaatttacattcctagcagcagtgtaaaagtgtgcctatttctctacagtctcacaggcacctattgtttctgactttttaatagtcgctattctgactggcatgagatggtatctcactgtggtcttgatttgcacttctctaatgatccctgatgttgagcattttttcatgtttgttggccatgtagatgtcatcttttgagaagtgtctgttcatatcctttgcccactttttgatggggttgtttttttcttgtaaatttgtttaagctccttgtgacttctgcatgttaagcctttggcagatgggagactgcaaaaattttctcccattaatatgtttttgtagagatggggtttcaccatgtttcccaggctggtctggaattcctgggctcaagtgatccacgcaccttagtctcccaaggtgctgggattacagatgtgagctacctcatccagcaaccaaaattttttagtgttattcgccaatgctgctattaaagaattacatttcagtttacacttacgtcgatctactttaggaatttgtatactgatttgcatttatccaaattggaattttttttaaatactgggacttttctctcacagaagaggtctgagatcttagtctagcataaatgacgaaatggggagtgatagaatagaaaaccaagagaaaagaagttatttaagagattaaaagaaataattatctgaccctttcacatagtcttgggtgctgaattgcaaattctgctgtttctgctgtgacagaataataataattttcttttcaatgatatagagatatttaacaatgtttactatttcatagcactagcaaaacaggaaaaaatgcttgatgtaataaaattatttcacccgattattaatcaaatatagaatgggagaatgtatattaacattatttgtcttttgaaataatattatcacaaatattaacaaactttggatagctttttgatatcttaattcctgataattgctactaattcatttctaagtaacaagtacaatataaattccagatttaaattaaaaatatttgatcattcacaatgctatgactgtattacatttcaatattttacctcgtgttattttctccataaatagagtggttatggttcacaggtacacatgctatttgtttatttatttcattttgtagagagggtcttattattttgcccaggctaaaatgcagtagctattcaaaggtgcaataaagtgcgttacagcttcaaactactggcccgaaaagatctggtttagcattctgagtagctggaattgcaggtgcccagccactgtgcccagccacaattgccactgtgcccagccacagtcagctttttcaagaactgtttaagataacaggttagggaaaatcaggataatattttgaggggaaagaaggtaaaatcaattaagacagggtgcacagagtacttgaatggtacagctgatgtttcatcctttgtactaaatggtgtgtatatgggaattggttatattattttgactgtttgtagtcatattatgtacatatgtgtatacataatttaaaaataaaagacaaaagtaatataagctaaaattatagatattaatattaattttatttaaatataacaaagatttgccagtattcaaatgtctgcaattatccttaaaatgcacagaacctatgtttaggtatagtatcactgttcatccagccttcattcactctaatctactcttatctaaaatttgtagtgtaagtaaaattacattcggtatgacagaagacaaattacagtattagaacattatggaaaattggcataacattgtacaatcacccataactttattatttatcattttgtaacttttttattatattagtcaaaaaatctaactgtacttaatagctaatacatatattatttgattttttaaagactattattaaaataataataatttgggggtgagaaggcctattgaaaaatgaccaacatataaatcataaataagtttgatgcaacaaatatttgtaagtcttataggtaaaaatataaaaatttattctaaacaaagctaaaagacaataatatgcattgggaaatatttgcaacattcacttcaagggttgatgtccgtagagaatttttacaaattaataaacatttaaaaagttgaggagtggcaatagctatgagagataatttacaaacacataaaaaccaatattaaaactgtttaatctgtaagtacatcaataaaaattttattatagtagttattttatctattaaattagaaaaggtcaatacaactgataatctcccaagggaatatatgggagaagcgctttctcatacacttataatatattgttagaatgccattaaataaacatttggcaaaaatctatatcctctgtcaaaacaatttaagttctagatctctagaatccacatatacatatacatatatacatacacacacacacacacattcacacctatatatcaacaactcaaatccaactccaattctttcataagcagtattttgtccaacaaacaaatttatctaaaattcttcttggcttttctccattatagagccagcaattttgtgtagctctacctctaattccttcatttgcatttatttctgctttcaagcccttatatgaggcaaatgggattaatttatttcattatcttaactagattcattgctttaatttgtcaaactctgattgatttgctcaactcaatcttgtgtgttcaagaacttaatgtggatttctgttccacctcatgaaagtcttttccaaaaacttgctaaattcttgactcaagacattccagttagtaatgcatttctctgctcaaatacaatagaagtgtgctctaataaatactcttcaacaatgtgcagttatttctccccaactatcaattccccttaaagcagaattttactaaaaatggctttatccttctgggaataatcagtaaaatggcaattggagggtgaatttaaaatatactaaaagcagatggcagaacatgagtgcagatttttactacaaagcttaggaagaacaaaaggaacctgaatagagaaaatgcagaaaagctctccctgggctattaggatgtagagagcagaagtatgtttaggagcttcaaagagtctgtctctttgcaactgtttatcttaggactttaaggaaataaaaggtgcaagtgaaccactctggattataaaatagaatttcacacagaaaaatcaactcagttaatatgcatgttgcttacatggaaatgttgagaaatttttagcaaatagaaagtggtagatggtaggtatatataaaataattgcagaaaaaatgtgaaatgaagatgtatggtattacttttatatttaaattgttaatatgttgcccataatgctttatttcaaagaatgaaaaaccggaaaaatagttccttcctaacttcccctgcagccttgtcttgtggagcttgtattttacttcatgagaaatgccaaagatatgtcatttaagctgaaacctccagcagaattagccagaatatttgggaaaaagatgtttccagaaaaagagctagtataaatgtccttaagcaagacggagctcatgatgattgaggaacaacaacaacaaaaagattatttcacccaagaaaagtgaattgggagtacagatataaatgatgagatctgaatacgattcatggagcaggtcaaactaggatgtttgggtgtggtctaaatgaatgggtggcatgagttgttttaaggagaggagtgacatgatttgacaagttcttaagagatccctttgattactctggggagaatagaacataaagtagcagaaatgaaagcaaaggggagatagtgggaaataattgcacatttataagcaagagatgatgttggctgggactctgattatagcaacagatgaagaaaaaaggaaatactgagaatagttgattggatttgctgacattctcaacataaatggaaatcagtatttttttctaataaatatgatatgcataaatatttttaaatatttaattcttttaccaccagtggggcatgagtagacttcaggaaacatgccagtacagaaccatataaatgtgatcattggtagagataggctttaataggcatttgaatgtctccctcaacctggaataccacgaaaaaagcttttcgcttcgcatgttgcattattatcataccctatagctttctaccattttcagttacttaatattatgttttgcctcaataaataatagtactttctcttattgtattgtattgtatttgcagcaattattagtgaagttttacgtttcaatattacatctaaaacaaaacaaaattgtcccatactattttccattaaaacacgagatcactatgacaaaaaaagctaaaatgtcatgaaatgacttaaattggatgagagtatatgaaatacattaagaaataatctctgactctgtagtttttttatttgtaggttttactagaacatgaaatcaatatgtgaatcctggctggagtttgcatctaaatgtaataaaataaaatgaagtttaatattatcattgaaccattagtgtacattagtgagctggactatataaaataaactttattatatttagcatttgatttttatttatgtatattataaaatgaatatagtttatattataataaaaataaaagaagtagtatgttaactaattcgtataagatgcctacaaactacatacctgcctaaatttttgacctgtgaaacttcaatggtttgtgttagggcctacatttatatatgtacatgtgtagtgtatatatacatatatatatatatatatatatacacacacacacacacactatatatatttttgtgttatatatacacactatatacacactatatacacactatataggtttgtgttagggcctacatttatataggtacatgtgtagtgtgtgtatatatatatatatatatatacacacacactatatatatatatatacacacactatatatatatatacacacacacactatatatatatatacactatatatatatatacactatatatatatatataaaaatatatatatatatatttagggagggcattgttaatcctttaattttaaaaattttaactttgcagacaaagttgattatacctgtggcagaacaatgcatacagcaataaataaataaataacttttattttctgtggagctcccagaattatgaattattggatagattgagatttgccgaggtcattttcttagagttgcaagagcataggagaaagtcaagggaaataataagcagcacttgatttcctttaccacagaggatgggattctaaaaccaaattatctgactataaatcaagacctatcttttacaggctatgtgattgtggatgttacctcctctatgcttcaatttcctcatctgtaaaatggaattatagcctaccctattttgtagtatagtgaggataaattgagtgaatgtatgtagttcctagaatagagcatgacacatgataagtggtcaataaaatattgtttactactagttatgtgacagtcacttcacacatagtaatgatttaataaaggagcaagaagaatgtagagcacagcttctcaacatcggcactacgacattttgggtcagacaattatttaatgcagagggggccataggatgtttagcagtgtctctggccagtagtgtacctcctcctctccaagttttgacaattgcaaaggcttccagacattgacaaatattccctgaaaagtaaaattgtcccggcttgagaatcacaaatataaagtaaccactcaaagattacattactaattttgattgaatttgaccagcattatgaaatcaacataagcttaagtttctacacttgattttgtcattgtcagttagggcagcagagaactccagttctgaaaattctgagcatgtgctaatagcctataatataatcaaaactttcattttgaattgtatttcttaaaaaatagaaaacgtattaagcagcaacatggaataattaaccacaaaaatatggaacataaatctcatttgcctaatatctcttttgaagtcctgtttcactgtataagtattatgtgttttgtttcacagctagatacagccagttttttctctaagcctaaggttactcctcaaatttatggtggctttttgctcttctaagtttctataaaacttcagcaacctgcagcaggttgaaatttattgatatttagttattcaccaggccatatttacagtcagggattgacttacccaaaccagatgctccccctgccagcagatcactaggagatattgcaataatttccctggttactaaattagcaaaagattctcagggagagagaagggcaagatggcacagtttaatacttactattattcttttattctttaccatcattccttttgaatggattaagaatctgacatacacataacttactaacgaaagggagttaggtgagagggaagacatatttgtctaagaaaagtcttagagaaatattttgaaaagagatagaaagaagagttggattggagtgggtgggtagggaatcacagtaaggagatggatcattcacaatttctttagacatggtgaggcagccacaggaagtctgaacttgttgaaaccctaatccgaagccaaaaaaagtgctcaataaggtcatactttgatcacctctgcctaaagcagttattcacaccctacttttgggagaggaaacatctacaaacctttgttctctttgtttgttagcagagggatgacatgaatttgggaaaaaagtttgagagacagaatgagatttagctcaaacaaatgattgactcatgctgggttgaaaatgtgctctagccgtatgtagaaagctgaaactggatcccttccttacaccttatacaaaaattaattcaagatggattaaagacttaaatgttagacctaaaatcataaaaaccctagaagaaaacctaggcaataccattcaggacataggcatgggcaaggacttcatgtctaaagcaccaaaagcaatggcaacaaaagccaaaattgacaaatgggatctaattaaactacagagcttctgcacagcaaaagaaactaccatcagagtgaacaggcaacctacagaatgggagaaaagtttgcaatctacttatctgacaaagggctaatatccagaatctacgaagaactcaaacaaatttacaagaaaaaaacaaacccatcaaaaagtgggtgaaggatatgaacagacacttctcaaaagaagacatttatgcagtcaacagacacatgaaaaaatgctatcatcactggccatcagagaaatgcaactcaaaaccacaatgagataccttcgcataccagttagaatggcgatcattaaaaagtcaggaaacaacaggtgctggagaggatatggagaaataggaacacttttacactgttggtgggactgtaaactagttcaaccattgtggaagacagtgtggccattcctcagggatctagaactagaaataccatttgacccagctgtcccattactgggtatacacccaaaggattataaaacatgctgctataaagacacatgcacacatatgttcactgtggcattattcacaatagcaaagacttggaaccaacccacatgtccatcaatgatagaatggattaagaaactgtggcatatatacaccatggaatactatgcagccataaaaaatgatgagttcatgtcctttgtagggacatggatgaagctggtaaccatcattctgagcaaactatcacaaggactaaaaaccaaacaccacatgttctcactcataggtgggaattgaacaatgagaacacttggacacaggaaggggaacatcacacactggggcccgtcaagcggtggggggaggggggagggatagcattaggagatatacctaatgtaaatgatgagttaatgggtgaagcacaccaacatggcacatgtatatatatgtaacaaaccggcacgttgtgcacatgtaccctagaacttaaagtataataaaaaaaaaaaaaaaagaaaagaaaatgtgctttttcaacaggtaggttgaaaatgtgcttcagcatttaggataccagatgtaaacatccatgcatagaattagaaaggttcaactttcatggctgctatggtttgaatgctccctccaaaacttatgttgaaatttaatccaaaataggataatattgagaagtggactttttaaagaggggattggatcatgaaagttcctccctcatgagtggattaatccattcgtgagtggattaatgggttatcttgggaaggaaactggtggatatataagaaggggaagatagacctgagctagcatgttagcattctcagccctctcgccatatgataccctgtgctaccttgggactcttctgagagtccccacaagcaagaaggctctcaaaagatatgccccatcgaccttggatttccaagcctccttagctgtagaaaataaattcagttctgtataaattacttagctttggatatactgctataagtaacataaaatggactaagacaatggtcttatcctgaactttgtaaactagaattggctgtttagcttcagcatgtatttttttatagattcaaaataatttcattttgaattgcataatgaaggaatgtcataaggttttcagcatatagaggctctaaatatcagtctggcattgtgataaagcagagagtttaaaccaagtcctatttgtgacacatgacctttctttctggttacagctcagtaacataggaatggatacttaactcaaggataagcatataatacatgaggctttttttcaaaattttgatttagaaaatgaagtattctagtatgttaattatagacatttcaactgagaagtctaatagcattggaccagaatagtcacagcagtccaaagccatggataaacttaagttaaaggcaacaaataataagagccttccacattaatctctatcagagaagatgataaacaggtgaatggggactagaaaccatgcagctttagaactagacataaaacaaacagctatctaatgatttcctatttactatgagcccaagatattcttgtatcctctcagttaagctcctgttttactaaggaaatttaagtaagattctgtctcttgcaagaaaataacatctaagacatcttcgaatttaatgctgctttaattttgtttataccagtggtccccaacctctttggtaccagggattcattttgcggaatataatattttcatggacagggttggggggaaggtttcgggatgaaactgttccaccactcagatcatcaagcattacactctcataaggagcgtgcaacctagatcacttgcatgcacagttcacagtagagctggtgcttctatgataatcaaatgctgccagtgatctgacaggaggcagagcttaggagtaatgctcactcatccacctctcccatcctgctgtgtggcccagttcctaacaggccacggaacggtaccagtttgtggcctgggggttgggacccctgttttacactataacatttgcacacgtctctcatggcctgtctttcagatctgctgtttgtctcgactcaagtctagctacctgaaaattagattttttttttaaattgaatttgaatatcttaaagttgaatacacagtctccacttttacacggcccctactgtcttacatcatacctctctagccctggaagatagcaactttacattcacttttcctgttttagggctattattttatcttcagttatcaaaatctatctacttttaaatactttaacttgaaaatacatagtaagcaattatggattatttaaaatagttttcccatgagtataaaaaaaaaaagaatagcaaaagcaatatttgttgagtatttaaaagtgccaggcactgtgcaacatgctttgcttaagtaaatgtttgacaaaatagaaggtcttttaaaagttccatgttttaacgttaataaccatatcaagataaggttagatattctatcaaattaccatttttgtgaagataggccttttctgctatatagaatctcctcaaacctgagtgttcacattatggattatctagtatactccacagctatcaagtttgtttgtgtttctttctcaagtaagctatcttatttatcttatttctccttatttcttcagacttttcctctcatttctttctctttttctggttttttttttttttttttttttttttgagactgggtttcgctcttgttgcccaggctggagtacaatggcatgatctcggctcactgcaacctccgcctcctgggttcaattgattctcctgcctcagcttcttgcatagctgggattacaggcatgcaccatcacatccggctaactttgtatttttagtagagacggggtttctccttgttggtcacgcttgtattgaactcctgacctcaggtgatccgcccacctcagcctcccaaagtgctgggattacaggcgtgagccaccatgcctggcccctatcctctcatttctaaggaaatgacaaattaagtattttatgcaaatacagtgtagggtcatttaaaatattttttgtaatagatgtctctgtacataaatctatttaattttttcttttacaataaaaaggtattaatgtgttttagtttcaccaaaaatttcagtagaccaactgtgtaaaggtacacatttatatcaatttttttgacctagtaaaaactaaagagggaaagttattcaaatatttcagcataaattccctttccttgaaattgcaatcgtcatgtgtagctacaattgctcagtattactctgtagtatgagtagctacaattcctcagcataagaaacactgaagtagacaattgttaagaaaacaaagtcataacaaaacaacaaaaacaacaaaattaaaaactaggatatagaaacattaactaaatgttactcttgaagccgatataagagaaattattgtactagacactgtggttcatcatccagatcccatcttcatgggaacacatcaatcccacactcataggggatatcagcagctgaccattcacatctgtacctttcacgaaatattgccctaagacaaactaaaatgaactaacctgcccaaagcggtgtctcctttcggagagcatccattgactcatagctggctaatgtagtgatacaaagatgcaactgctttgcctcaatttgggacaactctgaaagatgcccagtaggactggctgaagactcagttcaaagttgtcaaataaagtaaaccatgcccagttgaatttacattgtttagtatgagtatgtcccatgaaatatttaggaattacataaactacacattattcatgatttatctgaaatttaaattcaaccaggcaacttgtaccttcacgtggtaaatctggcagcttttacttagttgcatctgcattgtaggtaagcatgtcggtatgcacagacctctcttccgtgcttccttacaagtgcgtcccagaaaacaagtattcatctcagagccaacgggcattgaggcattcgataatcatactcccaaaggtcaaggataaagaaaatatcccaaaagcagcaagagaacaaacaagcaaacacataacatacaatggagcttcagtatatctggcagcagattttcagtggaaaccttacagccaggagagggtggcatgacacatataaagtgctgaaggaaaaaataaaaaataaaaaacttttaccctacaatagtgtatccagtaaatatatcctttgagcatgaaagagaaataaagaccttcacagataaacaaaagctgaggaacttcatcaataccagacctatcaaagaaaaggttgttagtgagcaagaataaattatctgaggatacaaacctcactggtaatactaagcacacagaaaaacactgaacagtgtagcactgtaatggtgatttataaattactcttgacttaagtagaaagaataaatgataaatcaatccaaaataataactacaataacttttcaaaacatagacagtataataggacatcaagagaaagagcaataagttaaaaagcggggggagattttcaagtgtagaatttttattaggtttctttttggtgtttgtttgtttatgtaaccagtgtaaaattgtcatcagtctgaaataatggtttgtaagataatatttgcaagcattgtggtaacctcaaattgaaaaaattacagcagatacacaaaaaaaggaaaagaaagaaattaaatcctactgccaagaatatcacctccactattgtaagaaaggaagaaggaagtgaagaccacaaaatcatcagaaaacaaacagcaaaatggcaagagtaagtccacacttatcaatgataacttgtaatgtaaatggactaaatgcttcaatcataagacacagaatggctatggctgaatggatttaaaaaaaaagacaaattatctgttggctataagaaacatttctcctataaagacacacatcgactgaaagtaaaggcacggaaaaatatattctatgccaataaaaaccaacgaaagagcaggagtatctatactcatataagacaaaatggatttctcgacaaaaactgtaagaagagaaaaagaaggtaattatataatgataaaagaagccaattcagcaagaggataaaatgattgtaaatatatgtgtacccaatactggaacacccagatataccaagcaaatattattagcgataaagagagatatagaccccaatacaacaatagttggagacttcaacaccctactttctgcattggacagatctaagacagaaaatcaggaaagagacattagacataatctgcactatggacaacaaggatctaatagatatttacagaacatttcattcaatagctgcaaaatacactttttccttcttctcctttttttttttttttttttttttaaagacagagcctggctctctcacccaggctggagtgcaactgtgtgatctcggctcactgcagcctccaccttctgggttcaagtgattctcctgcctcaaccttctgcttagctgggattacaggcatgtgccaccatgcccaactaatttttgtatttttagtagagaccgggtttcaccatgttggtcaggtggtcttgaactcctgaccttaggtgatccgccagcctcagcctaccaaagtgtttggattacaggcgtgagccaccacacccggccaaaatacacatttttctcttcagcacatggaacattctcaaggatagaacatgtgttagatcacaaaacaagtcttaaaacattcaaaaaaattgaaatatcaagcatcttatctaaccacaatggaataaaactagaaatcaataaaaaattaattttggaaatttaaaatatatgctcttgaatgaccatccagtgtttcagtgaaaaagttaagaaggaagttcaaaaagatccaaaacctatgatataacaaaagcagtactgagagaaatttatagcaataagtgcctacatcaaaaaagaagaaaatttcaaaataaataatcaaaagatgcatcttataaacctggaaaagcaagagcaaaccaaacgcaaaattacttgtagaagaaaataaataataaagacaagagcagaaaaaaaaattccaatgaagaaaacaatacaaaagaataatgaaataaaaagtttgtttgttgaaaaaataaacaaaatggacaaacttttaaccagctcacttagcaaaaaggagaagacccaaataaataaaagtggagatgaaaagggagacattacaactcataccacagaaattcaaaggataactactggctactatgaacaactatataccaataaaatggaaaatctagaggaaatggataagttcctagacacatacaagctaccagaatagacgcaagaagaaataaaaaaactgaacaaccaataacaagtaacaagattaaagctgtaataaaaactatcccggtaaagaaaagcccaggacccaatagcttcactgctgaattctaccacacatttaaagaactaataccaattctactcaaactattctgaaaaataaaacaagacagaatacttcaaaactcattctatgaggccagtattatcctgatatcaaaatcagacaaagacataaaaaaaaactataggccaaaatttctgatgaaataaatatcattgcaaaaatcttcaacaaaatactagctaaccaaattcaacaatacattaaaaagattattgaatatgacaagtgagatttatcccaggtatgcaaggaaatctcaacatatgcacatcaatcagtgtgatacagcatatcaacagaatgaagggcaaaaactgtatgataaattccattgatgttgtaaaagtatttgataatgttcaacaacctttcatgataaaatgtctcaacaaactgtgtttagaaggaactaacctcaacacaataaaagctatatataacagacccacagctagtattatactgaatggggaaaacctgaaagcctttcctcttatatctggatcatggcaaggatggccactttcattactgttgtttaacacagtacagaatgtcctaggcagagcaatcagacaagagaaagaaacaaagagcaccccaactggaaagaaataagtcaaattatccttgattgtagatgttataaccttacatttggaaaaacctacagactctatcaaaaatctattagaactgataaacaaattcaggaaagttgcaggatacaaaatcaatataaaaataaaaaattttagaaataaaaaattcaacacatttacaatagccacaaataaaataatatacctaagaattagccaaagaagcaaaagatctctagaatgaaaactacaaaagactgatgaaagaatttaaagcatacaaagaataaaatggaaagatattccatgttcataggttggaagaataaatattattaaaatgtccatagtacccacagcaattcacagattcaatacaatctatatcaaaataccaatgacattactcacaaaaatagaaaaaaattctaaaatgtatgtggaatcataaaacacccagaagaaccaaagctatcaaaaaaagaaacaaacaaacaaaaaaaacctggagaaatcacattacctggcttcaaattacactgcagtgctacaataatcaaagcagcatggtctgggcatacaaacagacacatggactaatgaagcagaatagagaacccagaaacaaatccacacatctatagtgaagttattttcaatgaagatgccaaaaacatacattggggaaaagatagtctctttaaaatatggcgctgggaaaactggatatccatatgcagaagaatgaaacttgacccctatctactgccatataggaaaatcacatcaaagtggattaaagactgaaatctaagacttcaaactatgaaactactacaaaaaattgaagaaactctgcaggacattggtctgagcaaaagttccctgagtaataccctacaagcacagaaaaccaaagcaaaaatggaaacatgaaatcacatcaagttaaaaatcttctgcacagcaaaggaaaaaatcaacaaattgaactgacaatccacagaatgatagaaaatatttgcaaactaaccatctgacaaagtattaataaccagaatatataacaagctcaaacaactatataggaaaattgataacccagttaaaattggcaaatatcaaatagacatttctcaaaagaagacatacaaatagcaaacgggaacatgaggaggtgctaaacatcactgaccaccagagaaatgtaaatcaaaacaacaatgagatatcatcttacaccagttaaaatagttttatccaaaaaacaggcactaatgaatgctggagaggatgtggagaaaagggaatcctcttacactgtgggtgggaatgtaaattagtacaactactatggagagcagtttagaggttcctcagaaaactaaaaatagagccaccacatgacccagaaattcaaattttaggtataaacacaaaagaaagaaaatcagtatatcagatatatctgcactcccttgtttggccagcactgttcacaaaagccaagatttggaggcaaagtgtccatcaataggtaactacatttaaaaaatgtggttcttatatacaatggagtactattcagccataaaaaatgagattctgtcatttgcaacaacatggatggaactagagctcattatgctaagtgaaataagccaggcacagtaagacaagcataacatgttctcacttatttgtgggatctaaaacttaaaacaactgaactcacagagatagagagtagaagccttggaagggtagttgggggtggagggaggtggttaatggatataaaaattagtaagaaagaagcaacaaaacctagtatttggtagctcaacagagggactatagtcaacaataatttaattgtaaatttaaaaataactaaaaaagtgtattggactgtttgtaacacaaaggataaatgcttgaggggatggagactcaatttttcatgaggtgatttttacatattacatgcccgtatcaaagcatctcacataccccataaatatatacacctattatgtacccaaaaatattaaaatttaaaaatatttaaaaatttacttgtaaaacagcctcaggccaatctttcaggagatattgcacaagaaggcattgttattataggagacaacagctccatgtgtgctattgccccaaacacctttcattgggacgagacgtggacgtggaagacagcgatatagatccacatcttgtgtagccctaggctaaaatgtgtttaacaaaaaaatttaaatgttaaaaagtatacatttaacaaaataaaaaacttatagaacaaggatataaagaaagaaaatatttttgtgcaggtgtacaatgtgtgccttaagctaaatgttattacaaaagagtcaacaagttaaataaaagtttattaagtaaagatacagtaagctaagattaattactgaagaaaaaattaataaatttattgtgatgaagtgtacagtgtttataaagtctacagtaatgtacagtaatgtcctaggccttcacatttagtcacttctcattcactgactcacccagagtaacttccattcctgtaagctccattaattgtaagtgccttgcattggtgtaccactgcttactatttatacagtatttttatcataacttttccatgtttagataatcaaatattttccattgtgttatagttggctacaatttccagtacagtaacatgctgtgcagacttgtagcctaggagaaataagctataccatatagcagaggtgtgtagcaggctataacatctaggtttgtgtaagtaagtacagccaatcatgttcacacaatgacaaaatcacctaatgcatttcttagaaactatgcctatcatcaatcaaggcatgactgtatatcagaccactttacttatccaaaatgagccttgtgacaaattcactctctagaacaaaattggatgatgaattagtaaaaagaatcccttaacacaaaaattatgacattttcttacatcttttactttgttagaccaagaatagaagacttttcttctcactagtaactgcaatcaattggtatgacttggagtaccaggtatatcactcttggcaacacatctatttttagtaggacaaaactgatgtgaaaaactgaaaatctcttcaataagagcattgaaactaggaaaggggtttagtgagatttagtatatgtatttatttacttctctgtggtttttaaacttatcttacttcctctttttaaaactctgtcagatttatcactgatttcagaattacaatctttaccatagactacaaatccctgagtagttatgtgatttcctcccttctatcttcccagtccatctcataccatacatttattggtcttctatgtcctagacacaccagccttttaagaggactctttattaatcacaaagatgttgaacagatgattctgacagcctggaattttctctctccacttttctttttcttttacctaggttgaattcattgtttagatctcaactgaaatattccttctttgtggaagcttcaccacatgacccagattatgctaggtctcataacatgctggggccttctcaatattgtgattaaccatgagcatgatgtattttgcctggactatattgcagacaaagggcggactgcaaatgcagctgccgaacaaatatctgtggaaagaaaaaatgattccttattttagacctctactctgtctcattagcattaaatgtcacacaagtcttccaagcttatttatctgattttccaacctgagataaaatagaagcagctaatagatacacagcacagtggaaaggcaatattagaaataggttcagcaggacaggcgcggtggctcacgcctgtaatttcagcactttgggaggctgagaagggcggatcacgagatcaggaaatcgagaccatcctggctaacacggtgaaaccccatttctactaaagacacaaaaaattagccggtcgtggtggcgggcgcctgtagtcccagctactcgggaggctgaggcaggagaatggcgtgaacccgggaagcagagcttgcagggagccgagatcgtgccactgcactccagcctgggcaacagagcgagactccatcttaaaaaaatgaaagaaagaaaagaaaagaaaagaagaggagaggagaggagaggagaggagaggagagagagagagagagagaaaagaaagaaagaaagaaagaaggaaggaaggagggaaggagggaaggagggaaggaaggaaagaaggaaagaaagaaagaaaaagaaagaaagaaaggaaggaagaaaggaaggaaggaagaaggaaagaagttcagcaatggaaaagaaagtaagtcataaaagtgaattagaatgcaaagtcaaagaacacatccacatttaatgggtttttttttgtttgtgtttttgaaaatttaattgaagaaagtaaagttaccctggcttataataaagttagatattataacaaaagataagtcagtgaccttaatatgcaatgtgttttggtttactcatcagataaaatatgttattaatgaacaaaataaaaaaatctaaaaaaggaacatgtagagaaacctagagcttagcagtatagttctctgaaatattaataagttaagaaatatacaccaatgagaaatgacttcagaagtttcactccaagggccattatagctctggaaattcttaaaggattcattaaattttcaagcacagaaatttgttcatttaattgatttttatatatgctttttaccccttttgttagttctgatcatccttaacctacacaccaaatatgctacaattaaaaagagaaagctcataatattttaatccccaaacataaaaactgaatttattaagtacctactaaagtctagaaactttgttacacataccacataattttataactaaatatgtaacatcacaaaatcgagattcaaaatctaacattggtggaaaatgcaaagcatgagtttaataagatattaaccaaaatgcacacctctgtctctgctataactacctcacctctggtttgcactagacttgggttgccacttgatccatagagaaccgttattaaaaacaaaccagagagtaattatgtcaaaactcacaaagccctgatttaaatcatgagaaatctgaataaagcctcccttgtcacacctgtctaattagcacggactctaaattgaggaggggagccctaaaaaggaattttgttgtagctgtaaaaatgtatactctttaccagcagttacaaaaacaaataatcttcatttgaagcaagctctccaatttttcaccaggatagtgaatgagcaaagctacatatatcctgcagagttgctagacacacaaagcaaaggatataggtattacactaattaacaacaatgggacaaatcattaaacatcaagtagaacattcagccaagatgatgaacaaattatctgtaagctaagattaatttgttactgaagaaaaaaattaataaatttagtgtgatgaagtgtacagtgtttataaagtctatagcaatgtacagccatatcctaggctattaaatgttataagtattagtagtagcagtattggtagtattatcctcttttcaaattttaaccacagagcttacatatgtataatgataacatgataaataggaatcagtttttacattggttttgatggttcacactgtctcaactcatggtatcttgttagcaaaagtgcctctattgtccagttaggcctgattttagtctggcatacaattaaatctaatatgtggatgcacataaacagtttgattagatttttggggaagtaggtttctgcagacatgagccactgcttgaatatgcaatatactaatccaatcaatcaccttgatacatttagttgttttatttttataattctctataacaggtttatcagtcaaatttattggttatacttattggtgtaaatgaagaaatactttttttgttccctctcatcactacctttaaatatgctcgttggaatctctttttcccatcacttgagaataactccagccaatctccagctatctagcaatttccaaacacactttcaataaaattgaaagacaataaatctatttttggtaaatttgacttactttcaggttttaaaaaggtctagttgcatgtaaattaaaactacaattttgcaaccaaattaaaacattttccctacctgttcctcacctagctcagaattgatatgtaacaggaagacctgtggttgtttatccagatgtccttcttttgtctatggctccattaggattgtaatggggaaaacaagaatcatagcaggaagaattaaaagaaaagagaaaagctttttttttttttttttttttttaaataatctcatctttatttctattgagaggcaggcacccaaatgcttcttctgtcggggagtgaatttgtaagttctttgtaactctgtgctacctatttgttaacctgagtaatttgttctcctgctcacttcttgctaacacttgccagcggatacctgaagcctcttacatcttctgtggcatgcacttggcctatatatagcatattcattcacctaaagtgggaagaataatctggcatcttttctctttccccatcttgccatcaaaagctgcctcaacgagcatgtagccttcagaattttgaaagccagaagcaggtaacaacttgccatgtttagcttcatcttgaaactcttgaggacacctatcaaactttcccaaaactgtctcatcatgtatggttccattgcaggatgggtgcaatgctgagtgccagcaggggaggaatatcccattctttccttcttgaaattgcccccagtctttttgagctctcttcctatttggaaggagaactaaagcaagtttagttctcctcacaaaagagaaaataattgaaagcactctcacttaggcagctaattcactgtctatatgataattcttagaatgcctagtcctctctttacataagagcacaggtaattgaggtcaatgaaggttgtagagtcacagaacttgtctggctactttttattaaatcctgcaaagacttaactattcttctgtaatttagggataccggtcatttaatagggaataaacaaaaatctgagacataaggaaattctgtatccattctatatatgtataaattatatatagaaaaatagtttagaagagttaatatcaatttgaaaataggaattttaaagctgtgaataatacatagcataaatatgtataaggattcagcaaaatgttagttgacatgtggctaaataaacttaaagtttaagaaagataagaaaagaaaccaaatatgcataaatctggggacaaaatttgatattgctgctaataaaaaggggaggggcatcatattgggaagcttcattaataaaagtaacaaattatgagaacaaatagtcttattatagtttatctggtgaagcattttaatgaggcgtagttgtctgttccattacggaaagagttttcttatgtgtgctctggtagattttcatgtggccacactgaaagatactcccaaatgtctgactaataattctatttataggcaactgttctgaaggtttaaagtaaggaggatgaagttcatttggaagcagtggggaaaaaaatggtaatgctgggctttgaattttatggatgctgtagctgttctttatttttcaataaataaatgttttaaatgccatgttttttagctattgcagttaaactgccctcatctttttgcccagcaaaaaacccattaagttattcactgagattgactctagattttttataaaattaataactttgctaccagtttctcaaaaatgagtagaaacgacttttcaatgcaaatgccagtttttgctacagtgaaattattctgtctgtagtgactatttgaacatttatgggcaataggacattgagagatttagtatatgaactacgaatagatttatccttagattatctaatacatgttttccaccttgcaacataaaacctgatctctttttaaagtcctggttgttctgaaaaatgaaatgaaattatagtaaatggaattttgactggggggaaaaaaacttcacatgatttaagagaatggatgctggcaattgactatctactgtttattcaaagcttatagattagcaaccagatgtggcagaaagttggctgtttttcattcacaacaaaaacgatgctgtgcttaatgaacggaggtttgttatcccagtaataagtaaaaggaacatgaaagcccttgtgtttaatgcttatgcaaataagctatttgcaggtggcttttgggcagaaggtaaaatagtttcaaaactgggtcaagttttttaatcctcaaaaattgccagctagaggaaaacctcctaaaatctttattatgctatttgccaagtaaatgaaatgacatcatttatcatttaataaattacatatgaaaattcttttccttatgatttcatcaatcaacaaataaattctagaggattctagatacatttatttggcatattttttaatgcggtatcaaattttgtggatattcttttagagaatcaatttcttaaaatggcattgaacatttaatttaaaatgcccttcttgaaccatacatgtttattagaaaattattttatataggttgtccattaaaaaacaattttctatgtatgtaaacatttatgataactgctcaatattttggtccatatttatttatctacctatttattacacaatacaaatattacactttgtaaaattaaaggcctagtctaatattactctatgtcggaagtaaaataattcagagaagtctatattaaaagacaagataaaacacaaaatgatgagaatcacaaaaccattgccaaattttcagctatgacatttattctccatgtggccttaggtatcttactctcttattttaacctttgatgactataaaaataatttgttactaagaagccctctcgctttagtagctgtgactataaaattaagaacataattcacaaaaagtgtttgagtcttcctgaaaacattttaaaatatcaattaatcattgcacaatacacaatcgcctgatcatttgctaaaagagggttgcattctcatctctgttcactctgtcctttctgagactcatataggtgtgagagctagaaaaaatattaatgtgtagcaattcagattttctcattgatgaatcacttcagcagtgcacagaatactttgtaattttaaaaaggtgtttttattaatatacttctactattctaccccaatcaacagcaaatttacctaaatcatgagactgctggaactgctaagttttataaataaaagacttaagaactactattaaaccctgtgaatcctttatctacaatgagaatgtccatgagtcagctcttctgaccctctggccagtgttctggagttactgatctgcaactttctaattgaactctagcttggtatgtgagagcagctgtgggttaaccagcggggcgacatttaagtcttgacattgccattaatgattcaccacctgttgcaagttcaataagttattcacacaccaaattgtggccacagaattcattgagataaactaagttagaaggattgggtgtcaataaatgtttgctaaatcagaattgttaatgatagaaatccgtagcttaacaaagttgagaaatcttgtcttcttaacgtgtatttattgacttcccaggatatgtcttagtgaggaaacatagcttctggcatttattattagagggataaggaataataaaccacagtgattgagagacagggaaaggccgggggacctagagacacagtaacagaagaagtttaattggctaatgaaataaacttgagataagagagcagagaggaggttcaagagatgaaaccacatattcctctctatctgctcccaccatcaagggaattaataacatattttataatgaatccctgataaatattagtgtataattgaaaatctattaaaatgactatttctcagggtgcagaaaaatattaaaacaagtaaagttgccataagatggaatattatattttcctgcatgtctgcttcaaggctgaatcctaatggtcatgtatgtaggtaaattattcttcctacagcaacttctgggaggtggtatgtggtggggtataaaaggccaggggtgtagtgagggtaaagtgtaagtactttgatcttgagccttgactatattggacttgggatctcagaaatcttggggataaaccgtggattaaatccataaattcataaagtgttggttatacaacgggtagaaactacgtgccacttttggagggacagtctcctttttttttaaaaaaaaaaaaggccttaaaggctatatatatatatatatatatatatatatatatatatatatatatacagtcttttttattataataaatactattttgttttttttaaatgaaacaatctgcacatatacaactccactctgaaggcaattatttacataattatgcataaattcctatagttatgttagtagttgcctttcttcagagtggagtcatatatgtgcagattgtttcattttaagaaaagaaatatttatttatttgattaactgaaattatgcttaaaaatgattaaaatgcacagatctgtcttcatgaagtttaaatgtcttataagaaattaaagtaataaagactacaacatttattatttaactgtaactgtagtgggtagtaaaagagaaagcccagtgtgttggctttcagtagtaaaaaacccaacttgtggttaggaaacgccattgtttattgtatctaaattaatcaagttgtatcctgtaacaggtttcctgttatccactcgtcttccaacttctgaagtatgctttaaatgacaagggagaaacccagacactacattttctaggatctcagcacaacagagctccaggtgaaattatgctaaatagtggcatgagcgtgagatgtgggtggcataaagaagaggtttagagtgtttttctggtgacctcctgtttaagtttgacaagcatctgaaatcactgctagcaactttcccataattattgtgtttccagcctttatgaaaatagcagcaattttttttcctttctttgcctatgtacaccatctaatcatgagataagtctccttcttagtccctatattaaatatctttttacatgaaatacatagattgggatctttttctgacctgttcctgtctgacatattcttcaactctaagatgagttcatactcatcttcggaagcccctgggaaatgggaagttttttttcatattagatgttggtagatatagaggcccatcctttaataaacatctatgtgccagaaaatgtactaggcacttagatacattattcatgtaactctacacaaatgtatcaacaacacaaaaaaaaatctgtataaaataataattattatatcccttatatggaaacagatccagagaggaagatacactagcacctgtaaatagaggatccaagaattaaacatccatctgtcggactgactacaagctctttctttttcataaaatgctaatttctctcctgcttctaatatttgtatcaaaatttgtcatctattgttattgggtttataggtgggtagtgactccttggcttctattttgttctagtggattactgtcttctttattttcattctagtgtttattgagagtcctaattaatcaacctggctgctctgacttccatcagctcaccattgtctcttttcccagctcataatttctgtaacagagctctaagctatgctaaacttctgctatatgctgtcagcctctctaaatccaagtgctcttatctgccaagtttacatacacatgtttaaaatcttcttattgaatctacatacaaagtcttcatgtcttcctccttgaaataatagcattgtgagagaaaaaaaatcttcattctttttaaaactaattcagaatgtctaggtaacacaagaacactctgcaacaaacaagaggtaagggaatatttacctggtatttctgtgcctcattatcattctcactcattataaaattggtatctgaaaaaaatcttgctgtaaaaacaaaaagtaatgtatagagagtataaacaaagagtttgcttcacatcataaccattatgcatcccattgccaaagggaagatagtacactacatgattccggggaggagcatcattcacatagactatagtgtgcatggcacatgcaagagaccccacagtactacccgctttgttctctttgtagacacactcacggatgattcatactccctgacctggagtagccaaataaagagttgcatcagtttattatcattctttccagaccactttctaggtattcccattatacattccttcaaatagaaagattttattctgtaaattgcatcgcactgtacacatttttttctgaaatctgaataatttcatacagtttcaactgtgagagtacctgacagactgacctaactctaagctaaaacactcataaactagcacagaagcttgtcatatcattacacatttatccattgctctaaattacttatagtttttcctgaaacatctattaatattgcagttatttgagatgactgtgagcttactatttgccagtgatgacatgagcaccttggtttagtctagtgcctggcatttaataggaccattctatttattttcctaaactctggcagcaagattagctctaagcatatttttttatcacaacaatcgtccatctttaactacatgtgaggaaagcactttcttatattgcattacacatttttatatggccacagaaatccttacttaatctgacaaaattaagataaatttctttctcctaagttcaaggaaagaatcattctctactgtttccaaggagatgattctccttttctcaattgccaattgtctactgcttgtcctgggttccatcttttcatatgtcatgaggattctcaccccagtgttctgctcctctgagtcaaagcccttgacttttcacttctcaattgttttgtttgtaatttttttgcttttatttttttctccataaatgctatgaaagtgtatgtaaaaatttacccatcttttattttatatttgttatcacattttattcacataccaaactatacaggaaatgaatataagcacatctttcttagtaggaggtagaagtaaaattttgtttagaataaaaacagaaaaaaagagaatccaattccatatcaccagtttgctcctgaatgtgcaataagtttccacttatgagcttgctactgtacacaacgcaagagcttttaaaaaattgtctacatgatagtggttaagagcgtactttaggctaggttactttaaaaaaatatgtcatcattacttctgccatcaaaagctaattcaatgtatcataattgttaaagttgagtagggttaaggattcttctcattctatggtttccttataaacacagtttctaataaatgtctatttttttctgtgaaattaaaccactagatattgctgaatgtctgtatatttcttacatttctagaatctcattcttaatttttttcttatatttttccttcaccaaagtcttaaaacctatgcacctggtgtctattatttaaattctgtgatgtattttatttgactttatttgtgtttttagtcttttcacagaaattagtttattgtgatcttcttttccaaaaggacttaattcatatctcttttccatacctatcttcattagcaggttgcatttcagtttcttcagtgcttttttagataatatattttactacatctttcttcacaacactgtatatgctctgatgatcaggtctctcattttttttaagttcttgtcccctttgggacccatgacaaagtaaagggcagattttttctcacctggcttaaaagtaaaaagccttcatatgtttctcctctgattcttcttaggcccagcatttccaaaaacaaactagtacacaaaacattagagttgcaatgatacttcaaaaggttcaaatactaatttttgtctgctttctctctatagttttcttgtagagaaattttctgttatgaaggttgaactatttgctatatgttaatattttccaaataaagtttccaaactgatatttaaatacattctctcatattcaaacatattctgaactactttctgttgtgtctctagatcaatatttataaaactagacagttcatataatttttttcctttgctaactttcaagatcatatcaaaaagtactactgttgattcggttttttgtgtttcattatttgaaactgtattgacctttttcctcttatttctttatcatttcctgttatttcatctttgtgagtcttcccattaatgtctttttctttttgaattatttattttttaattgacaaataaactgtatatatttaagatgtaccacatgatgtcttaaagtatacatacattgtggaatggctaaatcaagctctttaatgtatgcatatttaatatatgcattaccttgtaattgggccccttgagattttagtatctcagcatttttagtgcctgagatttaaaaaagtcggattaggctcttgcttgcttgcacaaaagccaacatcccttgttctcacaatacaattgcaaactgctgatgtactgtttctttgtcaagcaggagaagataacttcaaggtaacaaaaaacattcgcagaaggaaagaatgcctataagattgttgcaactaactgttgagacccagaagtctggttgctcaggatgttatcagagattaaagaaacacaaacttccccattggttccctaaaactccccctctcttactctctggctgcaaacaaacctctctgctttctcttattgttaagacatatctgacagatcttgccccgttctcgctttggccaagtggaataaacttttatctatctctaagcgttggtgtgtcagtgtttggtttcgactgagcatctggtacatgagcctgaatttgggtctctacaacatcttcacctagttactatttttgtgtgtgtgtggtgagaatacttgaaatctactccattggcaattttcaaatataaatgtattgttattcactgtagtcaccatgatgtgcaatcaattttttgaacttattcctcctggctaactggaattttgtgtcttttgaccaacatctccgcaatttcccccatgccctagcttctgatgatgaccaattaactctctgtttctatgagttttacttatttaaactctacatataagtgagattatgtcatgtttgtttttaagtgcctggcttatttcacttgacataaagtctcccaggttcatacgtgttgttgcacatgacaggatttctttcctttttaaggcccattaaccttttgtagatctgttactgaggtaatcaaagcttactggacaattatgttatttgagtaaattgaaacataacagcttataaagggtcaaatggtagtaatagcctaagaaataggtttggaatattatttcttagcataaaagacaaagataatattggtcagagtcttctaggcttgaattcttggctacttagattttatcaagtaaattgtaaaaggataaccaatcaatatttcacatgtatttctgtatgaattttgatttgacaagaaagactgtgaaaacaaaaccactattatctgtgaactacctaatgtggaaataaatatccttaaataaaaccttgagaaagtatattactcaattttttttctacagatatcccatatgttataatatttaactgaaaacaaaatctttcttcttaagaaaagattttattcagttttagaacgttaaagtttctccactctaatatatacagaacttctctaacctttaaaaatactgctttgcttattactcatgataattgggccacatacataattaaaacacaccatttattattttgccatgtgaaagtggcatctggttccccaacttgacttcaaactgtaattttaaacaaataataaagtgttttgaaacattaatgtcattaattgtcttatctattgtctatgttcatcaggagctgtgacatgcccaaaggaaggtaatcagaggaaggaagagaagaagctaagttctagagaatccattaatcattccttagatgactgaccattttattattttcccaagtaagctgaggctgacaatatcatgaatcatttacatatatcagtattcaaatgttccatttttaaattgggagggggtatgttttagaatagaataatgaaattccctccatctcctcctaatgtacatcattaagaagaatctaatggaaacataaggttctaaggctcttgttggaaaccataatcagaactggaggaattctcttatggaaaacattaaaaaaaggaaattctagcaatagaattcattgttaaagctgtaagttacaacaatattgtctctgcatgctgactgtaatcctctataatcttcaaaggcaaacaggaacagtaataatcttttcatgtactcttaacttccttctctgaaaggctagaaaatgtcttacatgtagcactcatagtgtcatttaatcaaacccagtttctatttttcttcaacttctagatgaatggatgcttagtctttcgggcacaatgtgaatttcttaagggtctgtagactacatctcctatttttacttctcaaagtttctctcaaattgtgataaaaagtttcactctattggtactgttaactgccaaccactttgaaggcctcctcctccacttttttctttttccccatatctaggcaagcagtaagaaaactcagagtctctattccttggctacggcagggaagttcaaaccatttaaatcctgaactattggggctgagggtaagggactcacttgggcccaacccttaaccccattaaataccagaactccactgactcttccttaggtttcacttcccactgaacctgagccctttttgttgtggattattttgccctttagtaggtaataataccatgtaagtaataaatttgtttcatttcctttcagtcttgatatccataaattactaggggcaggggtggtgtagagttgcctagtattcaccaaataaagtaaaaacaacacacacactgagagaaaaatctagagaaacattcccacattgccacacacagttttcttgcttgcttctggtaaatataaccttctctatccatgagttcaattaacaactttggataggaaatattcataaggaaaaatggatggctgcatgaaaggagagtgttctacctgactttattcactaatcaggatatgcctaaaaactgggtggcaaaaactgaactgtaggttttgagaaagattctaataacaagaaaaatgtacaaacatttttattgttgtttatccctaagcaagacagcataacaactatttatacaacatttacattgcattaagtattacaagtaatctaaaatggatttaaaatatatgagagaatataagtaggttatatgcaaatactaggccattttattaaaggacttgagcatctggagattttggtatctgttgggggatgggaggtagggcggcaggtcctggaatccatcccccatggatactgagagacaaacatacatagaagctacaaaagcaaattacttatttcgcctcttgctgttgacttaaggaaaactatgcactgtatcatcagtatagagagttcttgaaaagcctagatcctcccaaagtttgaataggtgttgcaaatagcgagatgtggtgatagctcaaatagagaacctctcgggaaaaccatttccacatttagaagcaagtttgaagtggcagatgactattccttttttataaatatatatatatatatatatatatatattatactttaagttctagggtacatgtgcacaacatgcaggtttgttacatatgcatacatgtgccatgttggtgtgctgcacccattaactcgtcatttacattactttttctactgaaaatattttcttggcttcctgtcaagtaatgtgagttgcaaaaggcattgaagattggaccaactaatgaaatggaatcaggacatggtttcataaaataagagtgtttttttgtaattatttatagtttcttcctttttttatttttttaacttatttatattccaaatacggtttgtcatttagctcaactttttattttgccccacatatcttcttacggcttcttggtttaataggataataaaatttctaaagcaggctggtctatggcttccttaaattaaccctgcctcttctcttacaaaagttactaaaggcaaatataaataatcatgaccaacatataaagatatgaatgagatttacagagaataactttactcagttatatagcgttacccacaaagggaatttactagcttcaattgaaaaaaaaatcccatgacacctatgatatttacttctgtcatctccacattcaaaagaaaacaaacagattacccacatatttaatcactttttattttacaaatgctctgtaaacaaaatgcttctcagacctattcaatacaattaaaatataacatagctttgccaaaaggtgtattccaaagttatcagttagatttattaactgataaagattagcaatttaatgtgaatgttttctttagtgaatatacagaattctctcaaagttaaattattaaaaacatacctaaattcacctaactcaaaaatgtagtattcttatactcaatatctgcacattctcacatatacaaaaatataatctaaatgttatttttaacaatataaaatttgtttctctctttgttattgccaagattgcactgactgttgaaatataaaagaaaaacagcattaaatcaggtgtgataaaatcacctttttctgtttatcttcactactggcatttattggcacttggaaactatttataaactcatattcttattgctaacatcaattattatgcaaatacttgaaatttttactgacttcataaataatgcatgaaagtctatagacttcaactagtgagcattatcttttgtggtttataaatacagaatacagaataaggtatagtttggatgagtctgaacaacagatgtttctgctttatgaattctggtcaaatcatttggaaagagttttgtttatacaataagcatctgcgttttggaaagttaaactaaaaattattttgtcattttctctaatagcttgggacctacataaatctgttaagttgaccttaaatagaactgaaggtgatagtagaggtatttaaaacaagtttggatagtttttacacatgtaaatctataacatacatttaccaaaatctaatatttaagaattaatggaaattatacagttattccaactctaaagttttatgacacaaatatattacttagatagtatcttcacattaattttgtttaaaaatctccattatgctttagaggggatttcagtgagaatatatataccccatcatattttatcaagctgaaaactgattatgcaactttttgtaagtacagagcaagtttaatccatttaactcatgccagacttcaggcatttaagaataactatcaagtattcctttaagaatttttctttacaggctagtcatccttacttccttcaagtaattgttaatttgcttgatgccaggagctctaaattatgtagaattcattttactaatttccattataatatatatttcgtatatatcatttgcttcctcaaaacccacagttcagtttttgccacccagttctgaggcatattctgattagtgaagaaaagcaggtagaaaactcttttactaaaaataaccaaaacatagttgggaggaggtgcttagggcatacatttttgaccttgtttacctcttagccaatactaagtgctttcacatataatcctataaaatgcttctcctccatgctacacttgaataatcaaaattttgaggttatatatatataatttcacaattgcctttttctttctctattcaacaaattctaccccttagacactggctttctctgtttcttctgtggtagttgatagaattttacctatatttatgctaataaatcaattatccagctatattttgcacaggggtcctgctaatcttcttgaattcttccaattttagtatacgtgctgccaaagcaagtgccagctatttttgaagaactgatatgtactcctaagaacacaagataaagagaatcctaggactaaagttggtaagccagttttttttttccatttcctattctttctttttacttctcgtcttccattctagagctgattcacaggaatccttcaaacacttcttggataggtctttctggagtcccttcaaaagttcctgtttatagatgcacataagatatgagagggtctgaattcttcatgagtccatctcttttgttggaactcaagaaaagagactagactggagagtagaactagattttttgagtcatgtgtaaataatgactacaccgcatgtacacatttagatgctgtccccagttcaagagttctgtccactgtcaaaattcatgtccacctggaacctcagaatgtgagcttgtttgtaaatcagtttttgcagatgtaactagttaagatgaggtcgtactggagtagagtaggccctaaatccaatcactagtgtctctataaggaacacttttacactgttggtgcgactgtaaactagttcaagggttgtggaggtcagtgtggcgattcttcagggatctagaactagaaataccatttgacccagccatcccattactgggtatatacccaaaggattacaaaacatgctgctataaagacacatgcacatgtatgtttatcacggcactattcacaatagcaaagacttggaaccaacccaaatgtccaacaatgatagactggatgaagaaaatgtggcacatatacaccatggaatactatgcagccataaaaatgatgaattcatatcctttgtagggacatggatgaagctggaaaccatcatcctcagcaaactatcgcaaggacaaaaaaccaaacaccgcatgttctcactcataggtgggaattgaacaatgagaacacatggacacaggaaggggaacatcacacaccagggcctgttgtggggttaggggagggggtagggatagcattaggagatatacctaatgttaaatgacgagttaatgggtgcagcacaccaacatggcacatgtatacatatgtaacaaacctgtacgttgtgcacatgtaccctaaaacttaaagtataattttaaaaaaaagaaaaaaaaaagaaagtgaaattcagacacggagacagagaagcacacaaagaagaaggtcatgcaaagaaggaggcagagataggaagaaagcagctacaaaccaaccagaaccaaggatttctgagagccctcagaatactggaagaggcaagggaagttccttccctagagccctcagaggaagtacagccctcagaggaagcaccttctaacctccagaactatgaaagaatacatttctgttatttttaagccaccatgtttgaggtaatttgttacggcagctctagaaaacaaatatacacaggactcttctttccaataggtctgaaatataaatgtatatttatatacatctccttgaatatataaatataatagagattaaatataacagatttatagatttataaacatataacagatttatatatttataaatataaaacagatttatataattttgtaaacacaaaatagatttatatagttttataaatgtaaatatatgcatatatatttaatttttaattactaaaattttttctataggctctcaataaggcaaatacacaatgaccaaacagaataataattgcttttcatttatagattataaatgcttttaattgatagattataaagaatttcatttatagattataaagaattactgtgggcaattaaatcaaagccttttcaaaaatggtgcaaaactaaatctatagtattcaactgatgtttaataaatattaaacattattaatatttattgttaattttaattaatttttaattaataattaaaattattaatatttaataaatattaataagcatcttattcaactgatgtttaataaatatttctgtggattattcctctgaaataatattttaagaatacacatgcatagacataaatgtacatacatggttcaatgtggtgttttattccttgcctataattacacgggtaaaaagaatgcatatttatgctgaaatgaaaccattttgctttctaaaaagaaacccagacacacatttctaagtgcaatgacagcaaatactgatacattcacatacattcttttgtcttttgaccttttcaagcaaaatcgtgcaagtatatctaggttacatctgattagctttcacatgttttagcaggttttgagaaattttgttttataactttgataaggtttggctgtgtccccacccatatatcatcttgaattgtaattcccataatccccatgtgttgtgggagggatccagtgcgaggtaatttaatcatgggggcgattactctcatgctgttcttgtgatagtgaatttgttctcacaagatatcatggttttataaggggtttttccctttttgctcagcacttctccttcctgctgccatgtgaagaagaatgtgtttacttccccttccaatatgattgtatgtttcctgaggcctctccagccctgtggaactgtgacttaattatacctcttttctttataaattaccaagtctcgggtatttcttcatagcagcatgagaatgactaatacagaaaactggtagtgcagagagtggggcgctgctgtaaagatacccaaaaatgtgcaaacaacattggaactgggtaacaggcagaggctggaaaagtttggagggcttagaagaagacaggaagatttgggaaagtttagaacttcctagagatgtgttgaacggttttgaccaaaatgcttaaagtaatatggacaactaagtcaatgttgaggtcttgatggagataaggaatttgttaggagttggagtataggtcactcttgctatgcagggagactggcagcattttgccccgcagaactttgaacttgagagagatgatttagggtatctggcagaaaaaattctaagtgctaaagcaatcaagaggaagcagagaataaaaggtttgaaaatttgcaacctgatgatgtgagagaaaagaaaatctcattttctggggagaaattcaagccaatagggaaaatgtctcgaggacatgtcagagaacttcacaatagcccctcccatcacaggcctgaagccctaagagggaaaaatggttttgtgcccctcttccgacaacccatgcagcctcaggacatggtgctctgcatcccagctgcttcagctccagccatggctaaaacgggtcagtgtacagctcaggctgttcttcaatgggtacaagccccaagccttggcagcttacacatggtattgggcctgcaggtacacagaagtcaagaatagagctttgtgaacctctgtctagatttcagaggatgtatggaaatgcctggatacccaggcacaagtttgctgtgggagcagagccttcatggagagcctctcctggggaaatgtggaaaggaaatgtggggttggagccccacacagcactgtctagtggaatagtgagaagagggccaccatcatccagaccccacaatggtagatccatccacagcttgcactgtgcacctggaaaggccacagacactgaatgtcagcctgtgaaagcagctgaagggggggcataccctgcaaagccacaggagcagagctgcccaaggctgtgggagctcacctcttggaaaggcataacttggatgtgagacatggagtcaaaggatatcattttggaactttaaagtttaatgactgtcctattggattctgggcttgaatggggcctgaagcccctttgtgttggccaattacctctatgtggaatggatgtatttaaccaatgactgtatccccattgtatctatgatgtaactaactcacttttgatttcacacgtttgtaggcagaagaaacttgccttgtctcagatgagactttggacttgaactttcgagtacatgctggaatgagttaaaactttggggaactgttggaagagcatgattgtgttttgaaatgtgagtacgtgagatttgggagggactaggggtagaatgatatggtttggctgtgtccccacccaaatctcatcttgaattgcagttcccataatcttcacatgtcatgggagggacacagtgggaggttatttaatcgtggggttggttaccctcgtgttgttcttatgacagtgagttctcaccagatataatggtttataaggggtgtttctcccttagctcagcacttctgcttcctgctgccatgtgaaggacatgtttacttccccttctgacatgattgtaagcttcctgaggcctccccagccctatggaactgtgagtttattgaacctcttatctttataaactacccagtcacaggtgtttcttcatagtggtgtgagaatgaactaatacaatctttttcagcttttgtttcttagggatgcaattcaagttaaggtaagagagtagtgtagtataaatcagccttgctaagacttctataaatcatgaattcagcagctaattcaaagcacaattttgtatatggtacaaaagtatctattgtagatgactaatttcaactctaactatcaaagtgacaaaaaaacgagctatcaacatcagccctcctcaaaaatgtatgcactattttactaatagtaacaactaaacaatgagcaatattaggaagattaaaacccataatgtaatgtactgtttgacagccaaagactttaacaatgtcctattctttctagtacctctggacgctttattcttctgctaacgtcagccctcctaatctttcacattacattcctatattgcaccatttcagaattttctgcctcacagttggaatgttaccagatactcctcagtgtatggaccacctgctattgctctcagctcatgtttggagaaaactggtttatgtaaaattttattttttttcttctggtaaatgaaagctaatttgcaatatgtttccatgggaaaattctaggcataaaaattatataaccacatctaaaattgctaaacaatattttttaaaatacttaaaatttaatgataaatcatagtcataagcccataaaataaagtaatatcaaaatgaaaattaggaacacaaaactatgtgctacagggaaaaatataatccaaaagttctcaaacagtctacaatatctataaaatctgtgtattgagtttctactctgcattcagcactgttttatgcccaaacataatacaatattcctgtttcaagtggagaagtttgggctgtatatgggatgttgtttccatacatcagtggccactgaataacaataaaactcacattctattctcatgaaggcatgcttgtaatggctactgccaaatgagactctattttacaatagggtgtgtatttcttatgtatgttttatgtatctcccttatttaaaggatttctttccatatgcttttcttttattaaagttgaagattctgttctactttacttttagacaactaacttttgttgtttattccatagagtctctatttgtttctcaccaatcaatgttgggcatgaagccaggcccaacagaagcccttagtccatggagaattacttttattcacactaccgtaagaattagtatcttaaaaattttccaatatgtgaatgtagtgcttagaaaactttaatcattctacattgcctttggcattacaattaaatatctggcttaatatataaagcctttcacaatttaacttaatggcagttatcttctctccatacaattcactcaacctcaaaacttaaaactacataaccattcgtggttctttgctttttttttctgtttgccaggctgtatctaagttatatcagattactcaagtgtcatctcttttatacaccctttgtgatgcttgcagggtgaatctttcctatggctaatagtttatataaacatctatcatagcttatgtttttagttatatatttacttgcagaacttgttctttgattacaggcattcaccatacatgcctccctctgacttccttcaaaacatacttcagtgactgaactcaacagtcattgtagcttagtagtaaaaacaacgtattcaggggccaagattcttgcctttggatcccagggtcacgtactagctgtctgaccttgagcaagttacttacttaaactttcagtatcataagtttcattactagtgtgctcatactagtgtacagcaggttcttaaataatgttgtttcattcaacatccttccattgtaacattgatgagaaaaaacaaattcctggtgggatccactgcatgtatacagtttgcaccttctccccatgtctgcgtgggttttctctgggtactctggcttcctttcctatctcaaaaatatgtcgtgttcattggtgtatctacatggtgctaaaatgacagagagagagaaacagagaaagagagagagagagtgtgtctgtgtgagtgtgcccttgatagaacagtgtcatgtacaaagtttgttcccaccttgtaccctgagttgcccagaaaggctttggacacctgcgacaggaacaagaaggcgaataattatcttacttgtttttattaatctttcttaaaagtacatatagctcatgtttatttcaatatttaatattataaatatttttatctttatttagaagcttgatgttttcatgaaaagaattatgtcataggaacttgactcttgtttatatcaattaccctatgatcaagtttgttcctatataagttgttttgcatgaagtcgtagttgtcaagaacctatggaggatgttaagtgaggatttgcagtataaaattcttaggttatttggagaaaaatgacttaatataattagtcccataatgtaaagattttagagattgacgtgaagtcagtgttttatgaggatattagaaaaagacaggtgagagacaggatagaaataagaaaaataaatattgaaaacatcgtttccaagaaagaataatttctatatgtaatcataaaattgcagtaatggatggatttactaaaaaatctattccagtgctcagatgaaggaactgaaggcctgtgaagtcacacaagtttaaagcagatataggaataaactcctatttcactggtctcttccagagaggtttttgttttatccttgactaaagtctgcaacgtgttttccttatgtcaaatcttgctcttaatgtttttaggcattctgtgaccttttgttgactacttgacttagctctttctatttgccattactttaaatgtatattataagcctgcattgaagtttttcaaaataaaaacatacccaagctgttcttttccacagatgatttggggaataaaaaaggagaaataatacagtctaatttcactattgaaacagagatcagttgaactaaaacagaagaataaatggggtataaagcagtccactaagatattcataatttcatactgaactctttaggaattgtgatttcttaactagattcatttatttatttgataaagttttactgaataccggctatgtgcctgactcatctattgattagcaagattaacatggttcctacactcacaatgctcacattttgctgtagaattcataataataaaaatcatcataatcataaaacttgaaatagggacaactgatagccatggaagtacttttctgaaaggagtaatattaccatatttcaggttttaaaacgtcatttcagaaaaaatatttggagacagttggaaggaaggtagagtatatgcaaggagaaggagacaaacaagatgctaatgcaacagggcaccaaacaccaagaaataagcaagtaaaacatggagcgggaatcccagttttttgcagaagattaaaagagaagccttgagagacatgtatttggtataatacacaaaatatcatcatgcatttaatatagggagtgagggaatgaaaggcatcagaaataactttcatctctctggcttgagaaacattgagtagacaatggtggcatttaatgagataaggaaaatggagaataatatattttatcgaggtagcgagttgaaggatgatatgaattttgaaccactgagtttgaagtgcacttgaggaactccaacgtgggagagtgttaaatagccaatgctaattagaaacattcattgaaaaatgtatttttaggagaaatcatgacattaaaactagaaagaacatatttttgaataataccatttatattaatgtctgataaacagatacaaagtgcctaaaggattcttttttataaattattgatcattcatttaaatgatactagattagagaatatttacatcacctgctataagagtgacagcatattagccaatggtattcatgctcgactatgcaattcagaagcaacatcaaagaatattcttcattgtgttcataaactttctcttaagtgaataataaagaaaatgtaatgcctagcaacattttctagcaattattcttctgcaatgcatgaatacatatttgtgctattgtagcattaggttcaacctaattaactcagaaaatcatttatgcacaatagcctatctttcatgtacagcagatcatgtacattttctttactttttgcaagttgtatgtaacattagcacacaaaaaaatagtggttgtggttctcggttcttagcactgctgtttatcacatccatgtccatgctagtttttccatgtgtgatttaactaccaagttaaccatttgagattagaccatctcttggatttatgactctgtgcctataatattcgagctgcctataggtctttataagcatatatagcaacacatgttgtcaacaacaacaactgcttagatattaaatagctgaaacctctggaattaggcaaactgtgtgcaaatattaaatattgcttcagaccttgagaaactttttttcaactacctgtgcacatatttcctcacctgtaaaatgaaaccaatgataaaacagaacctccttctttggactatagtaagaatttaatatttaatttttaacaaattcttatggtaaggacttaatatttaattcttgacaaattcttatggtaatgtttaattcttaccaaattcttatgataaggatttaatatttaattcttaccaagttattagggtaagaacttaatatttaaaatattcatttttcagcatatatgaagttcttagaatacctactagcatatgataaaatcttagagaaatttaacaattttattataaattagattgcttaatatataatcatgttacatgagttgagatagtcaatgcaaataaaaaataatcttcactggttatccttttatgttactcagctttcaatttctcataccatctcaaagaaaatgtagctagtagttatttttcagaatctgagaagtgttctgcaaatgtgcgtaataatttttgtcaatgttgaaaatctttaggactttctgtaaagtcgatatttaatgagttgaactattgtctttagcatttatgtcctaatttttggaaggaaacacacacacacatatatatatatataaaatgaaatcctatcttacttgacctaaaactgcacaaaaatttatatttgctgcgtttattttgcattggtaatatcaattttcttccatctgaatacaagtcatttggaaaattccttacatccaagttcttcagctcctatttgttaatcctttctttctttcttttcttttcttttctttttctttttcttttcttttttttttttttttttttgagatggagtctctctctgttacccaggctggagtgcagtggcatgatcttggctcactgcaaactctgcctcccaggttcaaggaattctcctgcctcagccttccccagtctggaaatacaggcacgtgtcaccacacctgcttaatttttttttttttttttttttttttttttttaagtagagacagggttttgctatgtggcccggctggtctcaagttcctgactttgtgatctgcccacctcggcctcccaaagtgctgggattacaggtgtgagccacctcgcctggactatttgttaatcttgatcttgttatatatcaactgctgggttgctccatgattttcacattctcttcctttagtttgtattgtgttggtttttgtttctttcataaaacactaaaaatgtttacatcattttaaaacatttcaaacataaaacaatatcctaagtagcttaacagtagagtccacacatgttgggtattaacgtaaaaacttttaagctcgttataagatcaatcagtctgttcatatcagtactcaatgagaacattaacatgttcaactctgttcagtcattagagaagcatatataaaacatattccaaaaatctaataagctgagtgaatgccaataggccagtaaatattgatataggatgttgctttgatggtaccaatttcattttatatattgtaaggacttccacctactattagagtaaatttcaagctatataatctcacattaagtgtcatttgcaatctgaacccaacaattcaaaataattatgttttaccaactctaataataataagacaaaaaataatggctattacttatcagtaagcaatctgagacctagtaaggatagatgacttatccagggtcatagtgttagctggtgagagagccaggagttgaaatgaggtggtttggcctcagaaactttgcactaagcccctaaatgtattaacaacactacgccaaagccttgccaggaagcgtttcaccatcttccagtgggaagccaagtaaacataaacttttaataaaactgtctgagtactgtcagagaggtataaacacttctaccagacagtaatttttttcaccatcctggaagaccctcaaggtcagggattatattttatttgactttgtattcccagagcctcccatgacacctaccccatagaggacctcattaaatgtgtgctgttgttttatagcaaagtgattccaaagcggtagtagggctagagaaaaaaaaaggctttacagtatgtacgagcgacatttgaactccgtcttaaaaaaataaatataggtactcaaggaagaaacacagagaagaggacatttgagacagagaaaacaacatgtgtgaacaaggcctgaagtgggagaacaatggatatatctaaataataggcgtttggatgtagggaagccagagatagtgtcgggcaagattctggacaggggtttgtggcggtttaggaaggaaaacctttatgtcaggctttcaccttcatagcttcacctgcacagccagggctctgttgcactggaatcagtagagggaatgggtacagtttcaagaagctctccaagagctgggaacaccctatttgtgcctcagcgtggttgaaatttagtctctccatttatgagcattacaaattttaataaaatgcaacaagggcacagttggggagaggttataaatgactaaaacaaaaggagattttaatattgaagagtatagaattaagttttcaaaaagttcgaaacagagtgcttatatataaatataaaataaataaatgtgattgacattaatttattaataacaaaacttgcaagaagataaatctgcttacctggttttaagcattgagaggaactaggagtttatatgcattttgggggaaatatatttaaataatatttttgtgtttacacagaataattataatagcttacagatagtaaaactatcatatttggggttattgtctcccctagacaaaatctataactaacatctatatttacaatgtctaggctctcatcaaataataaatagtgaagtcaacataggtaccttatcccatgtaattcattaatctttacacaagcctcttaaacagtgctccagtatgatagtaaaataccatgtcttccctctccggttgaccttatttccaaggttgagtatctagctagctagctattttaaacaagagcaacctaattctattgatttaaaagacagaataatgatcactgcaggagacagagaaagtgaacagttaaaaaagatgtttcactaagctaagggaggaaggagggcctaaatttagtgttggagattgaggttatgatacaaggtttacagactaaaaagcaataacatgccatgaagtagtttaaccttttatgttttcttgcctctgtacttctgcaccctctcacaccactacatttgtctgcaatatatttcccttatcctttttaaaataaagtttcacttttaataattaaaggtacataataggtatatatatttctatcttattattgatacatagcatttgtatatatttacaggggacatgtgatttttttgttacacgcgtataacatgtaatgatcatgtcatagtatttattccctagaatacttttcatctcaatgcgttaaaaatatttcaaatactctcttgtgtctatttagaaatatacagtacattgttgtttagtaactaaagtttactctcaatcactggaaattattctttctgtttaaatgtatgtttagacccattaacctactctctttatccttcccacatacatttcctagcctctggcatctagcatactagtctataccttcatgatattaccttttttagccccacatatagtgagaacatgtgataattgtttctgtgcctgatttatttcatgtaacataatgacctccattttaccccatgttgctgcaactagtgttatttcatgcatttttatggctgaatagtttttcattgtgtgccaataccatatcttctttacccatttgttggttgatggacacttaagttgattccatatctctgttattgtgaatagtactgtaataaacatgggggtgcaggtatctttttgatatactgatttcttctcttttgaatagatatctgttaatggcattgctggaacatagagcagttctatatttacatttttgagaaatcctcatactgttttccacactgactgcactgattgacattgccaccaacagtgtataagagttcttttttctccacatcctccccagcatttatatatattttttgtcattttgataatagccattctaactggggcaagatggtatctcatgattttgatttacacttccatgatgattagtgatattgaacattttttcatatatatgtaggttctctgtatgtcttattttgagaatgtctagtgcccattttaacaatgtgttgagatccttgtataatctggatattagtcccttgatgaaagagtagtctgcatatattttctcccagttctacagattgtttctttactctgttgattgtttccttagctgtgcagaaatttttctgtttttgttgcttgtgtttttttaggtctcagccataaaatctttgcctagatcaatgtcctgaagtgtttccccaaagttttcttccagtagttttataattttgggtcctaacactatgtctttaattgatcttggctgatttttctatgtagtgagaaataagggtccttttcattctttccatgtggatatctgatcttgccaacaccatttattgaagagggtgtattttccctagtgtaggttcttggtgtctttgtcaaaaatcagctggctgtaaatacacagatttatttttggacaatctatttctgttttatttgtctgtatgtctgtttttgtatcaacattatgctgttttggttgctatagccttgtaatatcttttgaagtcatgtagtgtggtgactccagttttgttcttttcactcaggattgttttgaatatttggcctctttatgggttctacataaatatttttctatttttgtaaaattgccattggcgttttgatagagattgcaatgaatttgtagattgttttggtatggtcactttaatgatgttaattcttccaatccacgagcatggaatctttccatttgtttgtgtcctcttcaattgcttttatcagagttttgtaattttccttgtagaagtatttcagctctttggattactttatttctaggtattttattgtagctgttgtaaatgggattgccttcttgattcttctttcttagctaattcattactggtatatatgaacaccgatttgtgtatgattaatattgtatcctgtaactttatttaatttatatatcaaatctaagaaattttaggtaaaatgtttagattttcctagatagaagattatatcatctgcaaagaggaaaaatttaactttttcttttccagttcgaatgccttttattttttttaatccatctgatgatgctggctaggcctttgagtactatgatgaactgcagttgggaaagtgagcatctttatttttttccagttcttagaggaatggctttccactttttccctttcagtattatgttagctatgagtttttcacatatggcctttgttatgttgaggtatgttcatcctatgcctaatttgttgagtttttatcttaaaggatgttaaattttccctatttctctgtgtctattaagatgatgataagattttgtccttcaccctctttatgtgatgtatcacatttattgattagcatatgttgagcaatctttgcatctgtggaacaaatcccatttgattatggtgcattatcttttgttactgtttgtttcaatttgatagtattttgttgaattattttgcatctttgttcatcaaggatatcaagctgtagtttttttttttttttttttttttttggttattgtttttagactcttgtctggtattggtatgagggtgatgctggcctcacaaaataaattggctgaaattccctcctccccaaatatttaaaataatgtcaggagaaatggtgttagatcttcttcgtaaatttggtcaatttgtcagtgaagcaatccagtctcaaacttttctttgttgggagactttttattgttgatgtaatcttattactcattgttgataagttcaggttttctatttcttcctaattcaatattggcagattatatttttccaggaacttgttcattttttctaggctttcaaattagttagtgtagggttattcgtaatcgtctctggtgatctcttgtatttcagtgctatcagttgtaatgtctccatttttctgatttatttgggtcctctttctttttatcttcattagtctagtgagcagtttataaattttatctttttttggaaaacaactttttgttttgttgaccctttgtattattattttcagcctgtattttgtttagttccactttgattttttattatttctttccttttgctaattttggtttggtgtgttcttgcttttaaaatttattgaggtgtatcattagattgtttatttgaaatctttctactttttaatgtaggcgtttattgctaaaaactttcctcttagtattgttttttttctgaataccatagtttttggtatgttatgtttcaattttcatttgtttcaatacattttttgattcctctcttaattatattcttgacccaatggtcatttagaagcatgttgtttaatttccaaatattaatatagttttcaaagttcttgttattttttattccactgtgttctgagaagatacttggtatattttgattattaaaaaaattgagacttgttttatgtcctacaatatggtctattcttgagaaagttctatgtgctgatcagaagaatgtgtgttctactcctgttggatgaaatgttaggtaaaagtattttatgtttattgggtttaaagtgcaatttaaaggcaatgtttcttttttgatgtttttgtcaagatgatctgtccaatgctgacaatggggtactgaagtcccccaaatattacattattgcagtctatttgtccttattgatctaataatatttgttttatatgtctgggtgctccagtgtttgctgtgcatatatttacagttgttatattcttttgctgaatttattcctttataattgtataataaccttgtctctgctgtttttgattaaaattcaactttatttgatataactgtagctactcctgctcatttttttgcttccatttgcatggaatatctttttccatccctttacattcaatctatatgtttctttacaggtgagatgtgttccttgtaggcagcatatggttgagactttgtaatttttaaaattcatgtctttttgtttgtttgttttagattcttgctctgttgcccagtttggactgcagtggcacgatctctgctcactgcaaattccacctccaaggttcaagcttttctcccacctctgcctcctgagtagctgggactacaggcacgcaccaccacatccggctaatttttgtatttttgattgagaccagattttactatgttggccaggctggttttgaactcctgacctcaagtaatctgcccgcctcagcctcccaaagtgcagggattacaggcatgagccagcatgctgcccccatccctgcctttttttaactattaagccagtctatatcattgaactacaaaatttaatcaatttacattcaactttatttttatatgtgagggcttagtcacatataattcaccacacatacatgcaggtggtggtgaagtcttgctggggacagggccatcaggtgggccagtctttggcccccattggcggcagtgcaggtcaattatgtctttccctaattttcagggctgcatacactagcactggtgtcagcaggtctatgtaagcaggtctatgcaattctgttgtccctgtgtggcttgcttgggtgttggcagtgacagtgatgaactgggtgggtgagtgggtcctctggctccaaggcagtgggtttggtggtaatagtagtggagggtcaatcctctgactctcaagccatctgtactggtgttggtggtggctgtgacaggctgcaatggccagtctctaggcttgcagttggtgcatacatgcgggtactagctgtggtggtagcataggttgagtggactcattttcaagcccctggaaatagtgctcagctgctaatagtgtaggtggggcaggatgatacacaggcccttgaagggtgtgcttgtgcactcaggagggtagagctacatcacatgggccttccctcagccccccggtagtgtttacagtcactggctgtggtatacaggggtggagtgatccccaaacccccaacagaatgtttagatgaaggtggcagaagctgcacttgcagcactgctgtggggttggggtggggaagcagaggttactttcagttttagtacacacgagcagatagctgaggaatgcaagtttcagccctaggtgacagctataaaccgggcagcctttcttcggggtgcttttaagcgtgtggcgaccctgctgctaaaggttgctgggtcactgtcagtgcctcatgctttggtcctagcaacagtagccaccagtggtgcctggctgcaggtgggggaggtcagtggcgttctaggaatctggagaggcagaagttggactctagggcaggatgcaaactggtggggactgggctctcaaaatagcactctgctgtggctgcttaggcttcagtgtgggtatggcacccattcttaactcccttcccagagcaatgctcttgccatccccatgcagcttcctatgatagtttcagtgcccatatgggttgaaggactctaccatggctaagatttcaggaatctgctgtggaaatgtggaccactggggagcatttgcttactctttctccagactaaggagcctctgcatactccttgccaattgtagccaagcgggctgcctcgctttggtctcctttcttgccttaggtgttttctgtcacatctctgttgaattccagcattttttcttaggtgatctattcaaagtgtcattatctactccttattttgtgaaggaggtgagtaccggatgctttccatcagccattttgaaggcgccccttcatctctttattcactgatcaggtacaaagacccttgaaaaatgaatgggttaagggcatcaacaccccacacaattgaaaaaccatacgtgatttttggctactccaaaaattaactaatatccttcccttaactagaagtcttactgataatatattcaattaacatataatcattctgtatgttacatgtattgtacaatatagttttacaacaaagcaagctagaaaaaatgttattaagaaaatcacaaggaaaagaaaacatatttattgtgtattaagtggaagtggatcatcataaagaacttcatcctcatcctctttaagtatgccaaggaggaggaagaagaacaggggttggtcttgctgtctcagtggtggtagaagcagaagaaaatccacatataagtggatgcacaaagcccaaacttgtgttttttaacagtcagctgtattttttctaaaaacgcttctcaggctatccaaacctaaataaacatgtatttattttaactactgtagaaactattgccatgcaatcatttagcaattactcatacaatgtcttatattagtttctgttttatgtgagcagctatttagatctacttttgtttaattttctgaaattatttaatagaagattttatactattggcatatagtaggcatttaaaaaatagctgacttattgcagaatcttctattttaaattttatttatattttttgattttttttttactatagaatatagtttcctgcatattcattacaaaaacatgaggtatgataaaagagcaaagtgttatatttaaaattaatccttcaaacaatgaatcaagtgtaacaatatttccctaggtcagaaactttaaaatacttaattttataagttaaaaagaatgttttggtaaatactgcaaaatacttttaaaattagagctgtatatttttaaacatctttttttcaaaaaagtaattatacatattttgagtaatgctcagtcatagcacagaatataaaacataatttttatatgacactctgatttatgagagcacaaattactttttagcattaagccagtgcaatcatgtgggtcaccttccaaatataaagaaatagggggaaaggaaagtgggcaacttagtaggctatgaataaggtctaaaagagtgtgttcttatatttatgttacaaaaataaagtgtgtcctttttgaaaacaaatcttaaatatattttcaggcagattctacatattgttctgctgcaaaaaatgttgttttaacatgtttcccctaaactgcatgacttagaactaaacataaaaatggtatttggttgctgttccaaatgttatgcaaaaaaaaaaaaaaatcaatttgatgggaaaactagacaaattagtcagtgggaattaggtttattaagaaatttcacctaatttttgttgcttttaatagttgcagttttaactgagtgtgaagaaaagttgccaagatgacatatgtcacatgtttcttcaattcatacatcctcaggcactagccaaaagccactgtatgtgtgtttttttcaaaacccacgtatgaaacaacagaaattcctttaataaataatgattgttatctactatgtatcagccaatgtgctaagcattggaaccctcaagaacgtcatgatctgcaaggaacatataagagacacaaatccagaaaaattaaaattaaaataaaaacgcatggcagtgatagcaacaggcacagtggattgtcgtcaggaaggacgtggggtcaaaagaagatttcagaaggaaataataactgaccacagttttagaaaatgggagcgagcctggaaaggagtggacaggtgtttatgcagacagagttgcacataggtagaggcatgggaagagaggaatgaccagatggtaaaatatatcctatatacagaggagcatgtaaattatcttcacagttgaaaagagttattttttaaaataaactcttctataaccattcttcaccatttttagagtaaaaaattgttgatttaaaaatgtgaggaaacacagacttctacataattgtgtactttgtttcacctaaatgcaggtgacagatagacctcagtgaggtggctttctttttaatacagaatttttatagatcagttttagataatggccacaggagtcattaagagccggaaaatggtaagaagagacaacactagcttaaagtgaatgcaaacacatactctttgagattttgccagatacgagtcaaaaataccttttgaggaagaagttctaagaaagtaaaacataagcaagaatatcttttttaaggggatatttggaagcatattgagcaagttattgccaactaaaacatatccaaagatactggatattgtccttgataaatgttctagaaacttttaggactgagaaatactagggtaagcaatgaagaaagagttggagagaaaaaatttaatggtcattttgtttgagatgagaatgaattttctcgtctgtctctctgtttctgagcacgctatgactgtatgcaagattttcctacttaacttcacagttttccttctattttattgttaacacttccattctcactaatgtggttggtaaaataagtactttaattatttgcttgcacattcaatattaaaataccatgctgtcttcagtttattatgagttcaattttcaagacactataaaaataatataacaatccattaaaagggtattctaaaatattttgtcattaggttattattttattatcttcaagtaaacaagaaatacatgagtaaccctcagcatattataaaaatgtgccaataaatttaaagaaaatttataaacataggaattctaataatttttctatatacatgaaggtgattattccaaattccattagattttctaaagtattatatattttgttatttttaaattctctataaacataattgtgaagccactttaatcaaataattagaaacaataatttgcaagcttgcaaaagaacacattacatatacatcttttaaacaattaaaatctaaagagtgattcctgataaagtaaatttagtgtaaacagaaatgcaaataaataaaactttcatttctatattcgaattgcaaaaaaatttgcaataatgaatatgctatttttcttgcttgtaaattatggtcaaaagatgtctgctgaatccatcacaatagtatcctaatttctcaactagaagaaattttagcaataaaaattaagtttagaatgataccaaagcttagattcttcaatacaaagaaaaaaaaatagtctcaaatcaatccttgttttacagatgaggaaaaattggatccaaaaatattaagtgatttgttcagttatccaggtaggaatttcaggatcaaaacaggaattgggtttgttatgtcaaatcctatgctaaagcctgtaaataagcttcttccaggtcattaagtcacctctatgaaagtatttatctcagtagttcatatgatgacgatcctttttaaatgtaatcaactaaggtagtactccctaaggatagggttaaacacagcaggttctcaggacaggctgctgataaatagacagagatctaagtgtgtagtaaggaagaacagtctatgactgagttagttaatggacgaagtataatccataggaattttttatatgcctttgaattacataatttattaacaaaacactaaacaaaacataaacctctctgaagctacaaatgtcacatgactgaaatcctggcatattttgctaaatagaatacagtaaacaatcaacactgattttgataaaatgtttcgaggtttttcaatgaaacaaattctttgaacagagtgaaaattaatttttacagattatatcaatacaaatgttacataaaacaatttcttaaaaggaataaaaactaagttctacagattatataaatacgtccaacctcttttacatggaaaacagtatgaaatttagcctattctgatatgttttcacaattttatataatctacaacttattctcctaaacttttttttaatgttagacttttaattgggctacttacaacaaagaacaaaatgttttatcatacatttttccaagtattttatataagtgtaattaagtttcatcatgcaggttcaagtcgcattgccacgattaagtggctgtgaactattgatttgacttatttaacatttcagtaacgactaatgccagtgattattgcactgtatggaagttgcaaaaaataattataatattcaacgtttattttacttgaaacttaaaactttatttaagaacatgaccagccatcttaatttaccttctaactaaatcattgtttgagttgtatatgtttggaaaatttatgtaacatttttaagccttaatatcactatttataaaattccgattacaattcttacttgcaagatccctatacatattacagattatgcatgtaaagcaactaataaagtgtttggcacccaaatcttaattcacttgcatttaatcatgctggacctatacagacctttaaacagtacagcaattataatcatattatatttttttctgaaatatatcttatttatacatatttattcagataagcaaaacataattagcagaaataaaaatcagtgtcatttattatcatttttgcattgcctctgagggcaagagatttctattagaaaactggtatctgtgatatttatggacatagctgcaggtaaagatgatgatgatgattgtgcaggaatgccatatgaattatttcaaaagtggtaataaacttatattgatccatttttacataaactgtcaacaaattcccccaaggccaggccttaacccattatatatatataatgaaagtgttaaagcttgtagcataggtcctggaagtgccctataaatgtaatcactatgcatattggatgtaatcactatgcatatgatatatatacatatatgcatatatatatgcatagtgattacatatatatatatatatgcatagtgattacatttatagggcacttccaggacctatgctacaagctttaacactttcattcataataagttacatggtctttttataacactatgataaggctattttctctacttaataaatgaaatacttaagtgcctgactgaagattacacacatagcataaccagattgcaaatatagggagtctgaatccacaaggcatacactcaaggcccctcatgctgcctgatgttgctgctgtagaaaggacacagataaatagaaagtaccatgactgactgttgtctagagttctttatctctgtattttgaaatcaacagattatctaatggattaagataacataatcattttctttcagatgaacagctgtgatcaatttagcaggtggtaactttttttccccagtgaaatgggaaaatgttagggtacattacaggtaataaggtaaattatttgataaaattttcatttcagttgcatatatgcatgtatgtatactggatcattatataaaaggtgtttcttttaggttataatccaaagaagttttgaaagctgagtttttttaaaagggtgatcagaaatttggaggaaagacagaattgtttgttcataacatgtactttcaattttgtggttatgtttcaactctttacactatttaccttcagacttctagaaaccttttctacactccaggttctttttgtggtcatctgttattctgtggtcatctatgaatgaacaagcatacaggcccatcatggggtcaaacctgtaatcctgattccatcatcactcttctctcctatcttcaatttgtcatcaatttctaaagatatattagatttgcattcttctttccagtatcaaattttcattaatttatttcagacaccatttctctttccttaatttctgttccaacttccttctttgcctccagcctatcttgtttaatccattctccttagtgctactgagggagcctcctaatccataaataggatcatgttacctccctgataatttatttacatctttctcattaagctgacaataaggtgaggctcttcatggttcagctgtaacttactccagccttatctctcagaactcatgacttaaatactacaaaatagttcatgcaaaaatctgaaattttctcagagtactttctgctccatttttctgaaaatgttctcccttttcctttcctcacacatactcctctttggccaattcctacatatcctttagtcctcatatgataagccattgctcaggaagccctcctggatcctttatttcttggttgggcatccctattagtgttctttttatttttattactgttcctataacaacactcatcatgatgtgctagaattgcatctctacgcatctgcgtccatcaccaaacagtaaattctttgagatcagtgagtatgtgttttgcacacagagtatggcatagggcctgttgtgtactacattcttataaagcatgtgtgttgaatgaatgaacgaatatattttttaacttttattttttcttcttgagacagagtctcactctatcacccaggctgatgtgcagggatgcaatcttggctcactgcagccttcgacttctgggttcaacaattctcacgcctgagcctccccagtagctgggattacaggcgtgtgccaacacgttcaactaatttatgtattaatatattttagtagagacaggctgttctcaaactcctgagctcaagagatctgcccaccttgtcctcccaaagtgctgggattacaggcatgagctactgcactcagccaaataaacaaataatttttctttttaaaatgaaatacttacttggcagagaccacctactgttacgcaatcattctatagtctttaaaatctaacactaatttcaggtatcaaaatttatatttttaaatgtttatatatttattgtcatgtgagattttatggtggtcaagttcaaagggcccaaatatctagtcgccctaataatattttcagtgtttttcaaaagcttacagattttgatcatttactaatgacactccactgctcactcaaagctacactgactagcacaaatatcctgcttctttgcttagagtgaggctgctagttggcgcattttgatgagaaattccaatcggcaggcatatgcagatttggatattttttaaaaaatgaaataagacattttaaaagtaacaggtttacagagaaaaagtttactaaaacaggtcctaaggaaaaagactttgaaaccagttacctagcaaactataaaagctaaatgccccaaattgtaatgatagccagttgcaccaaaattcaatgttattcatattttatttttcaagataaaaaagttactatgtattgccaagtttgaaactgaatgctctatctcattcctttaagccaaatctttacaagaaaaggatttctacttcaaaagaaagtgacacaatactcataattaacataaaaataagcatttgcctaatttcaggagagtacattaagtcattagtataagtggtgttttgctttgcactctctttacattattccatctctttccatctgggagcaaacttaacaagcaatttaaaaataattggtgaattaaattgtcattggtggcctcattttcctttttcgcgtatgtcttcaacagacttactctagcagtaccattaatacagctgcggtaaaaaaaatctgtgcaaatggcatgttataaaattaaatggtaacatattgtgttgcttgggatcacagtcaagtctagaggcaaaatagaaataacagatgcaatacaaatgtagagttattatgtgtgtcatactggaatctagcctcacaaaattagcacaatatgctctacctgaggataagctagggaaaagaaaaaaaaaaaaaagaaagaaagaaggaagattgtgccagcaacataaatggagacatagaaacattttaatcttaatatggtaatacgttttgaaaagaaattgtacatagattttttatttaaaatttcagaccaagagaaatgccttctatattaatatagttctccaaaatgttttttggatcatgaaatttctgacattccttttgaatttagtgaatttactagtttgaatggtcctaattaaattcttccctaaagctatttacagaggtacctcctgattttattagtcctttagtgatgctgcatgtctggtttggagagtaacttccagcaaatgaatagtatttatgcttaaaacttaaatgtgtgtgtgtaacatattgaatacgtaatttaatataatatctttaatactatgctttactaattatctaatttatgtgtgatacatcatatcatcatatagctgcctgggtttgttttgaattgtaatccaaaattaattatctcaattataataacttttatctttacattaaaaagtaaaagatcccttttcctcatcctcatagaaaaaaataagaatgttaaaaagaatcaaaactatgttttttggtgaaattactggctccatttatttgccctcccgctacttatgcttttttccatataactttgcagttccttctctaaaaattccctctacttacccgtttctgaacaaaaatatctcacttctcacagaaaaaaatgagggatttgaaaaaataatactgttaaattatataaacatatagtaagcattttcttacaactgtgagtgtaaatgatgtcacattgcatttactatccaccattcactacctcacttcaccgcctcagctaccacaactctcagaataagtacccatctccagaaaaaactcttgagtctgtttttagtgatttgatttagatgagtgttaaattatttgcctcgaaatataattatgactcactagagttgaaaataaaaattactattataatgagttctatgagctagatgaacaagtctacacaccatttgtaaagtacagtggttttgctagctagttggtagaatcacgatcaagtgatgccatcttggccagccatcagcaaactgtaatagctgatactgataattatgaataacagcaaacttgaaaataattacataattaaatacttatttgtgtaatgagctgcttttagaatctatgccagtgggtcaagtaagaagaagtaattggatcagtaggagacatttagtagttaagagacttgcttgtgcacacctaaaaactcaatggaggttaagtagcatatcactgccaaagagattctctagcactggtgggcctcagcaaaaccgtaagtggccttgtgagactgtgggactttagcacattactgcaatagactcataatcttatctaaatcaaagactctgaaaaaaagtgttatttgctacttaaaatgcaaaccattctacttcaaaatatatagaggagaaagaggacttgtcccaagataaaatgtgtcacatttgacaactatcaaccttatcagagtctaaaacttatatgaatacatgctgaaagtggatgctcttagttgtatttatccccattattaaacctaaatagagaagatcaaagccaaggactggaattttgaattattagtagctacaaatttctttcttaaagctttctggggcaagtgattgtcaacttcatagagtagaaaatcaaattaaaatggaataaatattattattctgaagacaagtgttccttttttcatagaaacattaaaagtatttgctaagtatgataaaacacgtatttctagaaaacagcagatataagacagtgattttcatttttttctatcgacagtataaacattagtatagaagtatgagagcccgtattgctgatgtttggagactaacattccttgcaaagagatgtctatgtcctttccaactctaataatctgtgattctataatttgatattaagcgaagattttagtaacacctaatttctgaattgaaaagaatttttaaaattctcacccacttactcaatacttgattttcttctatatgaatagcacagtcatatagttcatgcttgagccaaatttatattagcctaaatacatttttgatgaaatatttttgtttcacaaaaattcttatattacaaaattttctctaatatatatatgcttactgcattttaaatcggtctggcgctactggaaattgcttcatattaaattataagaaatttaataatcaataataagtatttggctgggttaaccatatttcttacataacaaatgctgataaatatatgtgtgtgtgtgtgtttgtgtacatactcttgtcaaattctaattaacaaaaatgtttaaaatatgttgataaatgcaaataaacattcacaatattattatgatttcatacatgttttgcatcaaaaatggcaacttgctattatattaatagctacattttaattggggtctcactaatctagaggctactctaatagcttccatgtattgaatgcttcctttgtctggaaagatagacttttatatgttaacattggtaatttctgggtgatgggactgcacatcattttatcttgtaattcttgattttgatatttctacaatgaacaaacattaaaaacacgattttaagatgttataaaatatatattatcctatttctcttttatttttatttttcaatagtttttaatttttatacaagctttggtcagtgagtaatggtacttccacagagtacataagatttcaatgtccaaagcaagtcagtctgtattgcatatattcagagctccatcaagtaaaattcaatgttaatacagaggtaagtgttaacagagaggaacaatgaaaaatcctatttaggacctgacttcaaatctcataagggatcagaaataccactgtactgctgaaagtgttttcctaggaaaaacagttttcatagcatagctcgctgagaactaactgatttttggcaattagatcacccatttttgagttaaaaaaagataacaattgaatatcatttgaacttctaatacctattaagaaaaaagttatttaaaaatgtttggaatttttggttggaaatctatgcagttttgaaattaaaatatcgattgtgagaatagtctcattcaaagttgaaatacactcttcagtaacaaaataatactgaaaagggtgagtgcaatgacaagaacatcatatgaacagatattatattctggaaaaagtataaaagcagattcaagtgatagagattgatatcccaattaaattaaaagaatgcccagaaaatcagcataattttcaataaaaatgatactttattatgagtaggtaagtagagagtgtatttatttagatgctccccactggtgtccttgtgaaaatggatgtcaattgtgtcaataataagcaatgctacttgcacctcaatttctcagaaggtgttcaggaaaagaaggtaccaggtaccttagcaggcaatgggaatgaggttgggatatttgaaaaataaaaaagggaaagattaactgaaacacttgtaaggagatttagatctccaaaattcttctttaactcacaatcaattgacttcagatttgcctatgcccatatatcacccctcacacatcaagattagaagcaagcacatatagcagtggcgaggtagtgaatagaacaaagtagccatttgtagcccagaatcagaaatgtaggaagtgatccagagaatagagcttgcatactgactgcagggggactatgcaaggagtaaaatattaatttctaggcaggtaccagaatctaaacaatgataagcaggtatatatctaccagctatcagaaacaaacatggcagagattcaaagtagagagtcaggcagactaataaaagataacagtagtcaaacagtatagaaacaatgtaatgatcacaaatgattctgtttctgccatccttcttctaaaattctatatgtgacagaaagtctaaaatgaaacaaaataatatggaaattataattaaaaattattcttgactgagttacagtcaacatgaacatagggatatggacaacagcaacattagaggggtcatatttgcagggtctttctggagtcaagtgaatttggaattacaacatggtatgtgtttaatgctcagcaattatgttatgagcaaacaacaagttatattggtgtgggattttgagcaaaattgctttatttattttatttattttatgaagggagaggaccaaattttaaatttcagttgaggctttccatttgcagaaatggtagattttcattttaggaatcttccattagataatgtcagctcctaatacttctcattctcttgtaatttctttttttattaaattgagattctcagtgaggtcatagtgtaatggagaaaaaataggtctgcgagaaaattgtgatgtctttaccaacagaaggtgataggatcgcaggtgataaaaacaaatgaaataaaagaaacagaaaacctaaagaaatcaatcctatactttgtccactccattttttttctcctttatttcttccactttttcttttgaaaggtacccttttagttccaaaaatgtagagaagagtatattcattattttagtttttgttttctttcaattgctttaaaatatttttctatttgatcctaacattcaccctatcaaaaagatattttgaatgttttgacaaataagggtgatgatgttcagatttcagtgatgcacttagtaattagcagagcctgtatccaaacttgagtttgacacatttttaatacctatgctattccttacaagctatgttaggttatagatgatttttcccactgtccaaaactaattttttatgtccttcataatcttcagaaatgtgttttgccactttaaggaggaaaaattgtctgtaaaatccaaaacagcaattttgctgttgcaatggaacccaacgagtgatgccagcccactgaattgaacagaaagacagtgatgattctttgtgaagagaaaaaatatacatacacctctataatgtgaacagagcataataagtggcatttttgcaatttggctgcttgacatcctgtgtgaagttctgaatatcctttttttgagcataaagcaaggacatggctttttttccccttcatgcactcaagggactcactcaaacacctaataatgctgttcaacctttaatacattcataatggaattccccagttagcgtgttttcacttgcctgggtagaggcaccagctacaacctcttcaaatacttaaaagaaaatactgttcacattaattgtaagaatcttcaaaagaatgctagaatacctcaaatggaaaattcacaagtagtagcagacaagaagacatagagcataggagtgaatagtagctataaatcagatacaagccacattaatgaattgagataagaagtgtgaaataaaatcgatccccgctcatcagagaaggaggagagggttatttttaatcttgggatgaatttaaaatcaataaaaaagtataatagtctcataaacagaaatcgaacgacaatgcaaggagttggaaaaaaattaaaaacaaagggaaaaaagtacaccaatttacttcaacagttacaagaagccttgtttgatagtgttaactgtattcataatgaacatgtgtatagagccttttaaaacatcccatcaagcactgcacagctgaatgtgaccactcaaataatatttggtgaacataaagaagaatgcccataaataataatcttccaagtcaaacatcttagatctaaaagttaaggctacaggaagagtgagaactctttgtgtgaagacactcataattaacaatatataagcaactacataaggctgaaataggcagggattgtgaaattccacaatatgagaacacttattttcttcttttcctctcataaattttgttcagaataccaatttggggaatcaagcagaagtaatccctgctaatagtgctgacactatgtcaaaagttttgagcaataaaaaaaaatctccgactttctatataccagaaactttcattttaccctagaaaatcaaaggacccctttaactaaaaatgtgtttctagaaaagtgttccaaaatacgtcatatggggatctagctcctcagccaagcaattgagcctcttttccttttgtaagcagcatatcaaagtaaggccaaagttggatactaagaaaagaatggagttacttatatttaatatttaggatacaaaataagagcaaagtataattgcataatgcttgctacatttcaaatttgtctccttctggaaggaccttcatctctgctccctgaaagccaaaaacaacaggctactatttttgtttttcatgaagctagatattagccagttgctagacttcaactgtgatatattcatgagaagacacaagctggagaatttcagcctagtctaagcaggacagatggagttgctttttacctttatacagatcacgagtttttagccatttatttttcaaaagtctagccttcagcagggagcatccatatgcgtgtgtgcaattcacattgagttctgaaacaagacttctggtttatccataaatctggcaaaataaattctcgaggcatagcctggcaacaaagaacttgaataaattctttaaagctcttttgtagtgaaataatattagaagttggggcaaagacaaagccatgagaggtgttgatctctaacagttttatgaaaagatgtttaagtaacttttcagtggcatcaatttaaaaatctagtcaatgatgtaacgttgaggatggagtttgctgacttttatcttccatgagcagtcagactaaccaggtgttagtaatttgaatctaagcaataaagactgtgaagccacattgatatagttaccataaatgggaatcagtgagtcccaccagcgtcacagagaacaattcagtcagtagcttgggcagggccctgctagtcattaacaactccattaagctaagacagaaactggaagcattgcccagagaggtaatcagaagcactatgctcccaagactttccttaacaggtgctcattttcatcctggtaagatttagaactaagcatatacatatttaagagaatcatattagagtatggatatttgaaatctatcaatatttactattttatattcttaaaatatttcagataatttgcctttttgaatcacatttgtacttatgatgtataattaagtaatttacatacagttatattaaacttagatctattaatttcacatagtagaggctactagttattcccaaatatgttcattcttcctttctttcttcctttcccttccttccttcctttcttttctttctttctttttaaaatactgctccttcctgtacactgattttttttcctttcttgttagcagtaaaaatcttgattttttttgtaagtctaaaagactgtaaaaccttccattctctgctcagttatttgtgatgttaggactgagttctaactacttaaatgtatttatagtgctatataaaacttccagaaagcatctttgggggaacaggggcttgcccttttcttcttctctccattctctttcttgggactctactttaatgattccagtttaagcagccattatagaccatgagattaaggattagaccgtggccatggaataatgttgatctgggaggaaggtgagttaatgaggtcttcagagagctgcagtactagctgctggtttcatatatctagacttctttcataaaacgcaaactgccattcatacttgtcattattatatatttgggaggttctatatttcaagaagctaagccatataataaatagtttgtatttaaaaagtcagagtattttaaaaggatatatgcataatggaatactattcagccataaaaaggaaggaaatgatttctttgcagcaacatggaaggaactacaggccataatcttaagtgaaacaactaaaacacagaaagacaaatatcacatgttttcacttaaaaatgggagctaaataatgtgtacacatggacgtaaagtgtggaatgattgaaaatggagactcagaagggtgaagaatgggattggggttcaccatgggaaattaattaatgtatacaagtgtgtgttattctggtgacggatacactaaaagccctgacttcaccactacccaatgtgttcatgtagcaaaattacactgttgtcacataaatttatacaaataaaaataaatcactaaaattacaacttttcccttattagctttatgaggtttatttaagtactcatgagtggtgtctttcagtcaaaataactacaaaggaaattttctatctagatttatataactgatataaaatatctctatagatctatccgtacatcaatatctatcaattacttctaaaggttattaactatacagttttctaaaaggatccacacattaatcaagtccccttctcctcttaaagtcatagtcaaaagttgttagaagttgctataaatataagtaaataatatggttttgtaggctaaacccagatagtaaaggaactaaactaatattgtaatgtcctagcctttcattttaaacaaacaataaaaatgcatatatacacaaaactgttttcttatgcaaaatgctgataagcattttttctaaaataaatcaaggtcacgtgatcaaagtgaagcttttgacaaattagactagtttgataacctgggttttaaagaaactgtatcctttttccttgattttagaagagaacagcaaaagataattataaattttattttaaaatataatgtgtatttttctcactaaaagacgagttaatatgaaattcctaaacttttcatactgttttactattgagctaacattactttcacatataagtaaaataaatttaaaactatgttttcaatcaaattagattataattttaagaaacatttttatagtaatggaatatagttttgaacttatattaaacccaaattaattggatacttggattatttttaactaaagtagaatattaaaatattggttaccagcgtaattttgacatacattcctttgattcttatttttacatgttatagagtagcaataacttagggccgtgtttgaaaatgtcttaatgtttgcctttttaaggtatggtaaaaaaaaaaatgtgtatggccgtcagatatcatactatatgtattcattagcatagctgtagtgttagacaaatctaaaccccatttcactccatgatgtagaagttaaatactaaaaattatgttaatatgggtaatttaaaatatactagaatcagtactggcagataagaagaattgtgtatgaaaagaaagataatgcacttttgtttattaagggaaaatgagagcagttttatcctaaagtgaagtatcagttattttcagatgtgaaatagaatagtaaatgataaaacctaagcaaatacaggaagtcatagtttttggaaacgagaatttaattatcttagattataatatcaaaaaataaggaatctcaaaaaatgtagtagaatatgttaaaattttcccaagagtaggttagttttcatggttggtcagttaatactgaaagcataaagaagcttgtgaatcttttactgccaaatattaacagcgcaaaattagactatttctattgaaataataaattaatcttgaattacttagtctgattttaacaatatataataattattttccttccatgtaaccttctgacatgaatggctcaccagagttgtttcctgtgtgttgtgctgaatttattatgccctggatcaatcaattctgaaggagctaagataccattaaattgggttaatactttctgtttatttaaaatattgtattttcccttgattaacttgtattcaagccatgaccttttattgttctcaaatactgatattaatattctaatcaagtgaatagatccctctgataactcttgacattttcttctcaaaattaattcctaaatttagaaaaatacaatttagtgtgccttttatacctaatactatcttcgtgatatctcagatgatcacagaaaaatcacaaatgtttgtcttttactctataaaaaagagtaatgctgaaaataattatagttgttggatatgctcctcatttcttacatagctcaacactatgatgagagctacaagaggagttgttaaacaaaagccttctctaagatagttttgttcaggaaaaacatatattgataattctctggagtgtagagtctctgaaatacatacatcatacacacatacaggcatacattagagagaagagagagatgtacatatacatattctggagactacattctggagatttataaatatccttatacttatttttaacctcagaacataattactaaatacccttatgactaaatatatattataccttaatagatcttactattctttatccttatgtgttggtcctctaataaatttgccatagccatttaattctgtctttgccaggttaagatttgcttgcttgcttgcttgcttgcttgatttcaactgtcctgtcttcaatttcaaatgaggaaaataatatccacaagtgcacctaggtaaaatgtttagttcaataactggcatgtgatcagaattaaattataaatctgatcctaaaatgaaaactcaaaatgagaaagcattaggattatatttctgcttctctgacatgaacactttataattaattgaagagaaatgttgagtggctaacagccagaggaacaagcatggctgtcaatgcatcttgactttctaattcctcatacaggaactttaaaagttagcatatggctgagcatggtggctcatgcctataatcccagcactttgggaggctgaggcgggcgaatcacgaggtcaggagatcgagaccatcctggctaacacggtgaaactctgtctctattaaaaacacaaaaaattagatgggcgtggtggcgggtgcctgtagtcccaactactcgggaggctgaggcaggagaatggcatgaacccgggaggcagagcttgcagtgagctgagatcacgccactgcactccagcctgggtgacagagcaagactatgtctcaaaaataaataaataaataataaataactaataaataaataaataatgtctcaaaaataaataattttttaataaaaaaatttttaaaaaagttatcatatgatatgtcctcaagtttatgttgaaaatgtaaatcacaggtttttaaactttgccacgtaacagaatcagctgtataactttaaaaacacacatatgccatcccacccgatccgctgaatcagaatgtctgaagtagagtattttacaaatcttcatcaaaaatatcaatgactagtaaaagtcaaaatactgatcatattaactgaatatttcatatgtagggctttttgtcaatttactattttttacctgaaataaatgattttgtgaagatataaaattaggagagaccattttacataggtgtattccaaaaatatcacctttccttaagtcagatactgaagtaatgctccaaaacccaacaattacatgttactccagatgcattagctttaatggcattgggtggtggtttaatttttagcccaccctggccagggatatttccttagtgacagcagtatggtctgcagcaaatgtgaactttaggaaatgcactaacgtataagggaaaggcagctatcagcattcagtcttctctgaaggtaagtatagcaaattaagagagatgtagtagaaatgcagtagcagttaagggatcaattcaaagttatcagaaaagggtatcttgtaggacaagttcaaagctgaagattgaattttaaatgttattgtgtgttacatgcaagtctcttctcatattttaaatttcttaacaaaatccactaacaaagtattatccctatgatgtctcaaaaaaaaaaagaaagaaaagttaaaaaaaaaaaagaaatgaaactccaagaaatatgatcaaattcacacagttaacaactggaaaattctgaatgtaaagatagctttttcaagtatctaagttctttcttcaacagtccacatagttttaagaaaccaaaactacattaccttgtaacttcccaggttaggtttatagagtagatgattagaaagtaataagttcttaagaggttaagaagagaaatttaacttattcctttgatattgctagggaagaaataaagaaagcagtggggacaatttcttgtagttggaaccccttatatcattttttatttttcatttttaagagcaatacagagaagattcatcaatctatgttcaggtagtaattgctttttactactttaagctcatctgtaaaaatcaaagtgaaactgactaggttttacgatattttctgaaaagtcaaaattctggtctttgctatcccttttaggaatatatggtaaaagtttccctatttgctcattactgattcatctgcataatgaagagttaaaatcttattgagaaatgccttgcaatcagttgagaatctaattgtacctgtttggaaaggttagttacaaaagcacccacggtgatccaaacttatattacacatcctctgattatcacatttaaagtaatatgtcatttgttattcatatttagtgttacaactctttaataaccactcaatctatttccctttaaaaggacagctgcaataacagcaaaattgtaaaccttaagtgtagcgtaagaattcaaggtgaaacacattccaagtagtagcttaaaatgtcagtatcatacatggctccctgaataaaagaggcaagacgtgtcaacctgaacagacattcatctctttgcactaaagtgagagatacaaagacctgtaccactcccagtagagagatgtgctgagacattcaagagtcaaagacgctcagctgtctgaggcaaatactgtgagtcttcaggtctctgtaaattgttctacagctgtgaaggattcaaagtaaaatttcagaatgatcataaatgaataaaatgtggtggattatagtagttactgtctttggctgtccgtaatttattatgttgctacttcttgtaactgtacagtagttctcctttattcaagtgcttgctttccatggtttcagttgcctacactcaactgtgttccaaaattattaaatggataattctagaaataaacaagtcataagtttcaaattgtgtgccattctgagtagcatgataaaatctgttacacctctccattccttttttatcacaagaataaggatgagtacagtactataaggtattttaagagacagactacattcacataacttttattacagtgtattgttataactgttcaatcttattattagggttgttaatctcttactgcctttaatttataaattaaactttatcccagtgtactagtctgttttcatgctgctgataaagacatacctgagactgggcgattcacaaaagacagaagtttaatggacttacagttccacatggctggagaggcctcacaataatggtggaaggcaaggaggagcaagacatgtcttacatagatggcagcaggcaaagagagagaatttgtgcagagaactcctctttataaaaccatcaaattttgtgagacttattcactgtcactagaacagcaccagaaagacttgccctcatgattcaattacctcccactgggtccctccctcaatacatgggaattcaagatgagatttaggtgggaacacagtcaaccatatcacacagttatataagtataggaaaaatgtagtataaatagggttcagtattatccatggtcttaggcatccactgggggtcttgggatatattgtctgtggataagaggggactaatgtattttcatttctctgggggtgggggcaaacaaaactcatagaatggatagattatggtgcctcctacacctacccaaccaagtgaaaccagcattttacatcagagtaccttattttcactgaacacagatattggcatattgtatcctgtcacccctgcatagaattttctaaattagaagagatggatacatctattttgctctttgattgtgaactttaaagtgtatgtttggagagaaccactctaaagagaaaacatctagagtgggagatgacaatcttaaacttcacccaaatccagtgaccctgaaaaaaaaaatgaaggttaagaaactcccccacccgactgtaaactagttcagccattgtggaagtcagtgtggcgattcctcagggatctagaactagaaataccatttgacccagccatcccattactgggtatatagcaaaggactagaaatcatgctgctacaaagacacatgcacacgtatttttattgcggcactattcacaatagcaaagatttggaaccaatccaaatatccaacaatgatagactggattaagaaaatgtggcacatatacaccatggaatactatacagccataaaaaatgatgagttcatgtcctttgtagggacatggatgaaatcggaaatcatcattctcagtaaactatcgcaaggacaaaaaaccaaacactgcatgttctcactcataggtgggaattgaacaatgagaacacatggacacaggaaggggaacatcacactctggggattgttgtggggtagggggaggggggagggatagcattaggagatatacctaatgctaaatgacgagttaatgggtgcagcacaccagcatggcacatgtatacatatgtaactaacctgcacattgtgcacatgtaccctaaaagtataataataaaataataataataaaaagaaactcccccacccttttgtattccagagaatggcttactgcaaagaatcaccctttcccatacaacttagataagacccacagatggatcccttttttatctatgaaaagatcagacacagatcctccaaattcacattgttgcctcataaatgattggctaaactgttttttctccactgattaactggaacaaaatagattttaaccaatttcggttaagtttctctctttctgccacatctctaaactttgacccatcttcagcctgaatcagtgtagcaattctccggagattaggtaggccgcagagtaaaactttctctgctctatgatgcagccaatcatgccaccctttcatgccacatataaccttacctacttctccctagaaaagacataccctttttgcctaacccttgtgaggctggcagatattatggtcatagtttttttctctattttaatagtccctttcttcacctcacaataattcttttgaatagggtctctctttgctaaatccagattcctctttttgactttgaaaatgaaggccacagccaaggaaagtcagaggcaaggaaggacaagaagtaaaagaggatgtcttggtggggttgaatccattgctcaattctggaggccctactttatgcagccctacagttgtctaacccacaacctttgactttagcatggagttcatgctctgatagctttcaactaaagcagccattctctcctctccccagctcttttctttctctgttgatacagataatattttgtatttgagggtctgaaacttttcaaaattcaaatgtcatggattgaaactactgtccttgcacagagtgtgagaatcaggtggtgtggggggaagtgctaataatggtctatgatccccagaaagcaacctatgttctaatgtaatttctacattcatattaaaatttagagatgattttatgttaataactcatctgcaaaagtgcaaatatatgtggctatatataatgtatatgaagcagtatgataaagtaaggagatatgtctcatgtagcaatgcaaatttgagtttaaatccctgttgtgtaatttttttctaaatagcttctgcatctataaaagaaaatatatctcctttattaagagattgttgtgataactacatgagataatactgacacgttttacatagaactcgatccataataagtactgaataaacaatatttgctactaccatttacattctaagtttaagagtagcattcagaaataagagaggatataatttccttgagaagaatgcccttgataatctctggtccttccatagagataataaaagttagagaaaggacaaatggggagcttttcttttttattcatctcatatttaaactttgtaatcacctttggattctctcttattaaccacctctaacttatcttcccccatccatgcaatatttactggatctatttcaggtctgtgtccaaaactttagttttctactctttgagttcaatgtcacattacttgtctctcaaatggatttcacaatagtctcctatttggtccttttcaagtcagattttgctttcacacactccactgaatgtgctctcttcttaataaaaaatctacaagcattcctctattactttaaaatcatttcagaaatcttaagaataggactctgtttcagataagggtaaaattctggacttcaagtaaaacatgaaaactagattaaatttcaggttattgtttctcacaggggaaatatgatgggaggattgtgctttacatatccttggaaagatgtttgccttgggatgttttttacccaaaacggtgactatagttatgttacctgcgactcaatatgcattcttcttttcttcttcactagtattacttcagtttggtcaggggctggcaattttttcaatttaaaatttcatttcctagatttacatttccatgaaactaagtttccaagtggaaacttccagtttcctggagaggaagtcctttggagagagttttgttttctttatgtagacaccaccactctttccttcttgctgcttccaccttcctcataatgtctgaaattaaggtctggggttttgagatacaggaactattttgcaaccatgaaacaagtcacacattgaagatggcacagttgaaagagagaagctgatactaggacatttgtgatagcatcaagccactgcatcacccagagctgcccactccagagttcattcaactatacaaaacaaacctttatttgataaagctaccatctctgaaggttttcttttcatgcattttatctgaataccaattgtgataggatgcccaaatagttttcaccttttctccaacatttatactaagctcaactctgaacactgcgatgatagaaatttaaaacttgagagagcttatctcagcctctcaatacttcccttattttaaaagttttaatggaaaaatttcaaacatatatttaaaaatagtaaatactatgaaatgcagtcacttatccattgcccaaactcaagattatcagcttacgaccacccttgttgtatccataactttacccgttctgtattattgtacatagagagggtaatgtatgcctaaacacattatcacattaccaaggaacacttattaacccacgcctcactgcagtgcactctcctgcagtcccctggcactggaccatagtgcttttgttggcagcacttgtgggagtgttactgccagtggacttggaatatcttggcctttccagcacatcaagcaattgacctcaaggggccagagaacaaagccacatcctggtccaagccatccagggttagagcaggaagcccaggagtgctgagcttagctttagtcccctgaaagcataaagaaagaaagccaattgactaaacccaatttgtaccacaggaaaaaaaaaaaaaccctcaagggcaccaaacaatataaaagcacaaatccccatccaaaggaaagaaacttcaaagattaaaagaacattagcccccacagctgagaaagaaccagcacaagaattctggtgactataaaacccagagtgtctttttacttctaaatgactgcactaactccccagcaatggttctcatgcagattgaaatggctaaaatgacagacatagaatttggaatctcgatgacatgtaacctcaggaagatacaggagaaggttgaaaccaaatccaaagaaagcagcaaaacaatccaatatttgaaagatggtacagctattttaagacagaaccaaactgaacctctggaaataaaaagttcactacagcaatttcagaatatgattggaaacaataataaagcattaataatagaatggaccaagctgaggaaagaacctccagggcttgaagactgtaccttctaattaatgcaggccgaaaaaaataaagaaaaaataattaagaaaatgaacaaaacttttgataaatatgagattatgtaaagagaccaagtctatgactcattggcattcctgaaagagttggagggagagcaaaaaatttggaaaatatatttgagaatattgtctatgaaaatttctccaacttgctagagggggtgacatgacaatttaggaaactcagagaaccccagacagagaatatataagatgactatcgccaagatatatagtcatcagattcttctaggttaacatgaaagaaaaaaaatattaaaggaagctatacagaggggaaggcaacataaaaagggaacccaattaggctaacagtggacatttcagcagaaactttacaggccagaacaaactgaggtcctatatacagcatacttaaagaaaagaaattccatctaaaaatttcatatccagccaaactaagcttcataagtgaaggatgaataaaatctttttcaaataaacaaatgttaagggaaattgtaaccaccagacctgccttacaaaaggtccatcagggagtggcaaacatgtaaagaaaagaatacctgctaatacaagaatgcacataagtacatactgcactgacactacaaaggaactatacaattcactctacattaataaacagctaacaacactgtgatgacataaaaccctcacatatcaatattgaccttggatgtaaatgggctaaacacagaatggcaagttggataaagaagcaagacctaatggtatgctatcttcaacagaaccatctaacatgcaatgaaacccataggctctaagtaaaggaatgaagaaatatctatcaaggaaatgaaaaacagaagaggcaaagggtcctattcttattacagacagaacagtctttaaacctacaattattaaaaaaaagatgaagaagtacattacataatgataaaagattcaattcagcaagaagacttaactatctgtaatagtctgttcttgcactgctataaagaaatacctgaaactgggtaatttataaagaaaagaggtttaattggctcatggttccacaggctatacaggaagcacggctgggagggcccaggaaactttcaatcatgatggaaggggaagtaggcacttcctcacatggccagaggaggagagagagtgaaggggtaagtactacacacttttaaacaaccagatctcatgagaacttactcactatcactagaacagcaagggagaaatccgctcccatgatccaatcaccttccaccaggcccctcctccaatattggggattacaattcaacatgaaatttgggtggggacaagaatccaaaccatatcactattctaagtatgtaagcagccaacaatggagcatctagattaataaaacaagtacttagaaacctctgaagagacttagataaacatacaatgataataggagacttcaataccccaatgacagtattagacagatcactgaggtagaaaactagcaaagatatttgggttctagagtcaacacttgaccaaatgcacctaacagacatctacagaacactccacacaataacaatggaaaatgcatccttctcatctgaacacagaatgtactctaagatcaaccacatgctcagctataaagcaattctcaacaaattcaaaaaaagcaaaattataccaactgccctctcagacaatagtgcaacaaaaatagaaatcaataccaagaacatctcttaaaaccataaaactatatggaaattaaacaacttgctcctgaatgacctttgaataaacaataaaatttaggcagaaataaaaaaaattatttgaaactaaggaaaacaaagatacaatatgccagaatctctgggacacagctaaagcattgttaagaggaaggttcataggactacatgcatcaatcaataagttagaaagatctcaaattaactatctagcattacaccaagaggaagtaggaaaaaaagatcaaaccaacctgaaagctagcagaagtaaagaaataaccaaattagagctgaccagaatgacattgagatgtgaaaattcacacaaaagaaaaactacggaaagcagtttggtgatttctcaaagaacttagaactaacatttgacccagaaatcccattactgggtatacacacaaagcaacataaatctttctaccaaaaagacacatgcgcacatatgttcattgcagcagtattcactacagcaaagaaatggaatcagcccagatgcccaacaccagtgcactggataaagaaaagatgatacatatacagcatggaatactatgcagccattaaagaaaaacaaaacaacattctttgcaacaacattaaagcagttggaggtcattatattaagcaaataaccacagaaacagaaaatcaaataccacatgttttcacttataagtgggagctaaacattgagttcacaaggacacaaagatgggaacaataaaaacaagggcctacttgaagggggagggaggagggcaaaggtcaaataactatctattgggtactgcactcactaccttggtgacaaggttatttgttcaccaaaccacagtgacatgcaatttacccatgtaataaacctgtacatgtatcccatgaacctaaaagttgagaatagaaaaaaacaaaaacatattaacccccaaatgatttactgtcacttaggagaggacaggggtctaggatatgatgattcaccaaaggttccatagtcaggcccggtggttcacaggtgtaaccccagcactttgggaggctgaggtgagcagatcacttgaggtcaggagttcaagaccagcctggccaatgtggtgaaaccctgtctctactgaaaatacaaaaattagctgggtatggtggtgcacgcctgtaattccagccattcaggaagatgaggcagaagaatcacttgaacccaggcaagagaggttgctgagatcatgccactgcactccagcctgggcaacagaagtgagactccatctcacttggaaccaactcaaatgcccatcaatgatagactggataaagaaaatgtggcacatatacaccatggaatactatgcggccataaaaaagaatgagttcatgtcctttgcagggacatagatgaagctggaaaccatcattctcaggaaactaacacaggaacagaaaaccaaacaccacatgttctcactcataagtgggagctgaacgatgagaatacatggacacagggaggggaacatcacacaatggggcctgtcagggggtgggaggcaagggaagggatagcattaggagaaatacctaatgtagatgagttgatggtacagcaaactaccatggcgcatgtatacctatgtaacaaatttgcatgttctgcacatgtatcccagaaattaaagtataataataaaaaaaaaaaaggttccacaaggtacaagcaagggtgatcataatggaacactttcacgttggatatccaaaggtataggaataaaaaagatttgagaatattgggaaataaaaaaaagatgatattcagaacagactaaattatctctctaatttggcataaacagtctgcaaaacaagggtgttttgttaattcacaacttgtaaaataaacaccacattattccatctaaagtgataattgatttccacagtgttaaaccaacaactttgaaaagaatttcatagtccagtctgatgccagaatccttatgcttctttctactttttgatcagtgtatattttgtaaacatacacaatgacaaatgacagcaaagatcactattttacattctcccttctactcttctacttctccatttttaatttgttctttaatatgaagttcttaaactcattatttaaagatatccaatgctatgaaaatttgatgtgtataattctccatgattatacatataaaagtatataattatatatgatttgttttatttgatttttaaataagtaatattctatacatattagtctatggcttggtttttaatgtgttatgataattcccccaagggtaagaaaatacttgtattttccaatttttgcatgcatgcatgcatatccatctgtaattataaatgaatcagtgtaaataacacatgctagattgctcttcttaatataatatgttagctgttcttttttccttcttttctcctgtttttccttttcctcctccttctcctcccctttcctctcttcctcctctgtctttatcttctttgatcagaccactcccttcttctggctaacaagtgtggaatgagaatgcttaaattcaaacatttggtcaagcagatatgttgcctagagcaagataacatttcctcacttgtaaaatgaggataagcataggccctacatttgaggttttggtattagaatatatattcatatacaaaaatgtttaatataatgcttggcacataaagagactataatcagtgtaagcagttattaactaccctgcttatctttccagccattctatttatatttttcacttgtttcgcagtgtttcagttataacagccttttctctcttccttaaataggccaaactttctcttgccttagggcttttgcactggttgtttcacccttaggtattttactatgaacttacttacgcatctttttctgcttctttttgccctctaaagtactatatataagttctataaaagttggaatctggtttgttgtgttctacactgtgtctctacagcctaatatcatgcatgacacagagtttatggtttaacatgtacttgttggatgactgtaaaattccatttgatatttagtatcagagtaacccataaagataggtattatttcctcaattttataaataataaaagtacaacaatgaggcttaatgctttattgatagttaagctgttgaattgggcttgaatgcagtttccttttctgtgtgttgtattctttccactgtttcctatgtgttatgcatttttaaaatacacagaaaattagctttatgagattgtaaatctcttcgaatcatgcattttactgtctctatgtaaaaattataagctcacaataagtacataatatgcattttttattactaatgattttcttcccttcatgggtttatgctttttctaaatgtaaaatatttgtctaatacatatatgtaaaatacatagtatgtgtaaaatatccttttctaagcttgctataaaatcttacttgtttatttaggtgttgatagttaaaattaatttggcaataggtatgcaggggatgtctctgaaacccttggaagacattgatggtttctgaacttcaactggtgtagcagattgaaggcaaatcccaggccaaatatacatatatatgtgtgtgtgtgtgtgtgtgtgtgtgtgtgtgtgtgtgtgattatatatatttatatataatatataaaatattatataatatatacatgttttatattatatatatataaggcataagacaacacagagagaatatgtttaatacgacagcaatttagaagtaggaaacagtcattgcttgtgaaataagggaggctatggtagttgctgtgctgagcaataatgaccaagtgaacataagtgggatattgcagccagaaataggaacaaaaacagaatagatagaatatttaaaaaaaaaacttgaaagctactgcttagaatgggcttgactcacatagctgtactgaggtgaaactaaaccaagagatctttggaaattttctcccgagacatacaagaatttacctagcaatatacagtatgcaccctttaaatcatcaggctggcaaaatcatggtttgtgtaatacttgacattgaaagttaaccccttcttttatttataattagagacaaatgaagaactatgtagaatgtgaggcaacaagaggtgtttagattgttctttcaacacttaaagacctggaatgtctggtcctttttctccacttttactgtaataaaggcagtccaaattctcatcatttaacccctgaatgaaaacaggatcccaacaacttgttcccctgatgcctgaggccaatgcacagtgtccggaattttcctcttaaatgtgaactgaccgtggtggtccaatcctaaaatctcacttcaggctcctagtgaagaactgttagttcttagctaacatcacgtttctcttggacagctcacatattcatagttgtcttctaatcttaaaatacacataaattcactcagcaagcttgtaaaaatgtacatatttggacctcaaattcaaagattctaattccatatttcttggatgtgacttggcaatttacttctaaacacatgctccagcaagtgaaataaatgactatataggcatgaagaactacttagatgccctaaacaccctgctattttacaactatttgccaagaacatcttccctgccaacttggtctttttgtcttggaaaattgctacaaattcctcacaaccctgttcaggtattgttcaggtactgatcacttctccaagctttccattattcctccttccctccactagatggttaatagattccttctctatatcaattctgtgccttgcagatacttattttactgcctattttatattttggctttattgtcatcttcacaaataaagcgtaacctcttgaagggttgaaaattacttttggtattagtggttagcaaactacttggcacatgttaatgaagaattaataattgctgaatttagcatttttacactgaccctaagagtaaggaccaagttctggttctatcacttttgttcagctaattatatgtagagatacagatatacatatacatatatacatatataaatttgaacacagggttctcctaacacacatcttaataggtacagaggagaaagatcttggatgtttgaaaaggtagagttgccattttctctctgtactctctctgtacatgatttttggattgagaatatatctagaatgtcaccaacaataaataaactatgctgggaaaatcatttataatagacagatttataatgtcaattattaacatactgcagactttttcaaataggggagttcacttggaaatttaaaaaatgccagctggtcggttctgagatcacagaaatgaagattcctttgcaataaaaagaatcactttgtttttttgtttttttcctaaatctccacttctgcttatagtgactgtacccaaatcaaggagttataaatattaatctggtaacttcaaattgagaattcatagccactaaaatgggttgccttaagaaaaatcttttttccatcatccaaggtcatatgcctcttatcaaaggaactacacatatattacaaagttattttcagtttttctcatgaatttctatgtatacacaggtctctgtatgtagctaataacatacttagggcaaaatgaaagaaaggaaggcaatatttcccatgctcctaagttaaaaaccctatttgtctgtgtgtaatatggaaatatttacatattatctgtacagatttgatcatatgccaaaacatgtcccccttcaagttctatctgctttggacatccaaatacaattcaaataactttcaacagttttacatgtaatgaattctcagcaaattaacacaagaaaataaaaccaaacaccgcatgttctcactcataagtgggagttgaacaatgagaacacatggaaacagggaggggaacatcacacactggggcctgtcggggggtcgggggctagggaagggataccgttaggagaaatacctaatgtagatgacgggtcgatgggagcagcaaaccaccatagcacgtgtatacctgtgcaacaaaactgcacgttctgcacgtgtaccccagaacttaaagtataataatgaaaaaaagaccaaagacgttttgtgtgtttaaattattcttaaagctgtataaaattagcttgtgaaagttgatctaactaagatacaacaaataaaatgatcagtgatatggtagatctctcttcctatagagtagcgatattatttaacatgatcattgtttagttataacaattacttaaaaagaaaattttgactcccatttggtataatttttctggaattcggtattaaagtgtaactcatattgttagatatttttcaccttgcattgtccatcacagtatctactgtatcaaatgcacagttcatgaatcagatcagctcttttatatatctgatatatcatagtttattaaacttgaaatttttgcgtggaaaatatcacatctgagccacttggaactttggagtatagtgaaactccaacacactgattttttttctcaatccaaataaagcatattggaaatatgtatacttgcttaaaaatcgtttctatatagtcagtatttaggtggataattcaaaagtactctacctaatataatgtgaatactaaggactaaaaaatatgattaaatttggaatctcaattttagagtttttgagatgagtttttttttgagaaattaacattaaatcattttcatgttttataaaaatggaacaaagtattctaaaatgtaaagaatgcttgtcctaatacctagtaagtaatccttaacatagagcttgaatcatgtaataaattgccattgttctgccctaaattttcaatgttaaaggttaacacttttgggtctaatagaataacaaagcagaaggactcctaagacattcttcagttgactaaactgtgagttggtactgaattgcctacaaaaactggactgaaaaaacagtgtttgcatttcagtaaggtgaatgtaagaaagccaattattaactcattagtattccgcagctttactttcaaagggtaggagacaaaaaaatgaaagaagaatgtatatataattttctgtgtttattctattgactgtgtgaaggtaccaggacagaataacatttggaaaaaaacaaatatgtattcataaattcaggagacagattctttttatgggcaaaacatgatttttttttgatcaactgattcaaaaaaataataatatgcaaagcaatggttatttccatataaccttaggctttttcttaataacaacacaattctaatttttgcctttaggattcctttaataattacatggctaataaactattgcttttcctcatgcatatataaatactgacttgttccttatgagaacattccagggtattattagaagcatttgtcttgcactttactctacgcaagcactttaatgatctcacattgtttggaaatcccaatgagcttttgaggtaagtctcctagccttatcattttacagattttcatttaaataataataatacttttattcctgcatagagtattatgtaatatatttaatacatatataatttatacaaaaatatacatgctatatatatatatgcacatctcatatgcatgctttttaatgcctttacattttttccttagtgttttattttataatcagtgctttataaaaggatgcattccttttgaaaactatgcttccttcagctactaggaacacagtatggtatatggaaagaaaaaatgaaaacctctgacaacacttgcagctaatatttattagattctttttgcttcataaagtgcataacaaatttgcatgcattttactcatatgatctctcacatcaagcggtaatggtggatatgtttgttattgctcctatttaacagatgagagtactgaaatataaaaaggtaagtaagtttcccaagcaactaagcaagtataagtcaagatctgaaacataacaatgtgtctgtggaatctgatttttaaatactgttaatcactttaacagcactaatttggcaataacttatttcaaaagctgcttcctttctctaagcctcaatttcttcatattaaaatttcagtatgaatattgcaacttttaggatactcatagcacaaatattatgtttaaattagtgattatcttagtactgagagtaatggtgccaataataatagtttccatttactaagtctctactgtataccagaagcactgtgaacattacttcctctaacctgcataacacatccccaagacgaacatttcacattttatagttagaaaaattaagaatcagagaaattaattttcccaagatcatgtaactaggacatagagtatctggagttaacatcctactgtatgtgactcaaagatatttattttcttatcaccaaacattgtaagtaatttttactgtattttacacatcaaaaaccttagccagcacactatcatacatttactgaaacagagtagatatccttatctttcacttagaggcattgcagcatggttaagggcaatgctcttgaagtcaatatagtaccatggaattaaaaacaagaaaaaaactgggcaagcctcagtcatactctactacagatgctctttgacttatgatgagattatattcaataaacccatcataagttaaaataccctaagcctaagatggatttcatctacccaacctactaaatgtcatagcataacatagcctaccttaaatgtgctcagaccacttatattggtctacatttgggcaaaatcaaatgcttatttcataattaagtgttgaatatctgatgtgattcattgaatatggcactgaagtgaaaaacagaatggttataggggtgttcatcatttatgtacataactgaaagcacagtggacataaagagtgtttgaagcattgaactaaaattaatcgccggatgatggagatgctacagcaacagagtcaccaatttctccttcttctgatgaggttcaaaaatagctggtacaggttgagtaacccttacctgaaatgcttgggaaaagaagtgtttcagatttcagatttttttgaatattggaatatttgtattacataatgagatatcatggaaaggggacccatgtcaaaatgcaaaagtcatttacatttcacgtatacacacatagcctaaaggtaattttaaatgatattttaaataattttgtgatatttttacatgaggtcgtatgttgaattttcttcctgtgacatcatgttggtgctcaaaaattttcagattttagagaatttcagatttcaaattttcagattagggatgttccacctgtagaagaaactggttattgacacttattgatggtctagagtttgatatggtttctctgtgtccccaccgaaacctcatcttgaattgtagctcccataatttccacgtgttgtgggagggacccagtgggagataattgaatcatgggggtggtttcccccatactgttctcgtggtagtgaataagtctcttgagatctgatggttttataagggtttcccctttcacttggctctcattttctctcttgtctgccaccatgaaagatgtgctttttgtcttccaccatgattgtgaggcctccccagctatgtggatctgtgagtccattaaacctctttttctgaattcacagtgttctttggaaagatagcaagtattgattgtacagcttatttcttattattacatatctttctgtaacaagcaagagcactgtgtctctgcctgtcagttctcatgagtctctcctaatcgacgtgccatttctttaacatctgtatgccactgctgaatgcagcaaaggcctccacaggtttctttgctgtacactttcttggttcctccggtttaacttcttcctctgcctcaacttctttacttctttcttcctacagtttgatcacttgaaaactcagtgccaacaaacccatgaatatcctcttcatcaatacccaattttagctgtttctcaagtgctaataacttgttacctactattcatcaacagcagagtctttgttaaagcttttgaatgtgttcacatatgtcttcgaaactttcttccacatgccgatcatgcactgctgtgtgacttcttcccatgctgttgcgatgttctggatggcacttaggatgtaaaaacttttccaaaactcttggagaagtcagccagactcagtcacttcactaatctacacaaatccttggcataaatatactttgaagggagctattgctccttgttccattggttgaatgaatgtggttttgttcagtttcaaatacacagtcaaaaaaattgcttttatttctgtttgtttattcacttttcctgattgtctttatgcagagccctaaagaagttagtggtaaagccaaacccttgacatcagcagaactttgagcagcatatttggttcttcatttctcctgaaaagagtgatagccaaagaacatatctaccctgatgccctgggaaaagttaatagtttggctgacagtacttgaacataattggagcatcggtgacagggaggactgaagaagatttatgtgattaattctctctacttgggtacagagcttaaacacatttgtgtcacatataggtgctaaccaaagagtaacttcagcagatggataagtgaaaccatttgtaggagatcaagtgggtccccttagtactcccttgtgttgtgatcaaagttattggaaaactacaatggactaacacaggaagaactactaatggccaaggctcttcaggaacaaaatttcaggtcattgtttcagacaaaaggacctgatgatctggttaaaataaaagtaataatgaaataggtagtacaagaaggaagctataaacaagctatgaccatgtgaccaattgcaaacataagaattgcgataattatgaaaagttctttcttattttggtgtgaatgtatttcaaaaagattaaccaaagtttcccttttttccacgtctcctgccatctaacataaaaatgtgataatagtaattaactttatgtcaccgtatttaactcatatgatactaaagagggagaagtgtatcagaagtggaatgaacatcgaccactggtgaacaaatgacttttgtgagtttgtatccactttcagagtgatggttagcgtgctttcagttggtagaagtatagatgcgtcaccttggaaagaagcatgattttaccgttacctttatttggaatgtaaacgtgatttaaaatggaatacattgatgtcaatttgagaggtaaactttagtgaaaccatatttttaagaataatttttttcctgttaaaattgctgcagcacccattgtacctcgtgtgggtaccctgttctgctcttgcatgctgttgctgatctgctgactttccttgtcagtatgaagtagttagtagcatacaggttaaaggtggtaacagatatgggttacaattattgtccccatggactctaatttggcttcatggatatcagtttgccctcactctcctctgattcacactaacttttccttcccagctgccagcctaggtgacctgcagattcttcacgcctaccaccagaaacagagagaatagcacttcacagattgctacaacagatcccagttttatagagtttattttttacagaaaatcttgattcatattgattattgtgttgtttgtttccatattaagtctcaactgatgtcttcagtttatgtgatatatcatacggtcactttatggataatgcatttgggtgatcacattaaatttggaaaatagtctttgaactcctggaattttaactcttagtctcaaaccaaacacatatctagtctaactttctaaaatatgactgaaatagatttatatagctactatatttttagtttcaaattttctctatacatttttaatagcattgtttaatacaagtccctggatatgttttctatgacctcaaaatgttttgaaattttgggtcaaataaggtatgtgagtgcttatttttttttctttgggggagtgttttcaaatgaactttgaagcccagttggacactaaccaaacatttaagaaaacataccataacccttgattttataaaagaactaatacctgctaatccagctcaataatgaaaacccagagatttcatctttcaaattccaagttgacatttggtgttgttatttataatgtcaaaagccagcaatttatttcttaagagaaaattcaaaacaccccttctagggttcttgacctccggatatctttctgtccaccaagatgtctaataaaacataaagtttccatgatataaatttaatatggattactgaaatttgagtaagagttcttattaaatttaaaagtacagagtattctttcttcactagtgtagatgcaggtatggtttcaggaaacctatcatagcttgaatattttaaaactctattgatttttgaacatggtatagacatttctggcattgtgtgtgtgtgtgtgtgtgtgtgtgtgtgtgtgtgtgtgtgtattattgggggatgatgcgtatatgtctaccaattaactgtacatacaataatatcttgctatcctacaaaaatggcattacatttcattttaattttttaatgaagaaagggttatcaaaatttagttactacttctgaaaatttaatcttaattttaaactagaaatgtcaaatggcaaatgggttttttcctcatttcatgaactgcaaactcacataacatattgatgtttgttaaatcatttgcagtttcttagaggttttaaataaaaatatttactcatgcagaatagttattttttaaaattactaacacgtagaatagacagcaaattattaatgaaagtataatttgactttccattattttctttaattcaaaatattatattctgtctaattatactctttaaaaatgtcatttcatgatgcacgtgtctactttatctaacttcccttaaagcctaaaagacctaagtgaagattttaccatcaaaagttaaaaactaaagcgagccattttccaagaattagacagtatttttacacagccattaaatcataccacatgacaaggctgataaacttcatctgtcatatgaaattatctaatacccctaaaataaaatataattttataaatttacctggttatctgaataatcagatttttcattttatgaaatattcttaaatgtacaaaacattttaaaaatatgaatacataaaatatgtatattttatactttaatttgtgatagtatgggttttaaaatattttagtgttagatttctttttctttgatttggccaaatattccatttcatttatttttgtttatttatttatttatttatttatttatttatttatgagacacagtctcactctgtcacctgggctggagtgcagtggtgcaatctcggctcactgcaaactctgcctcctgggtttaagtgattctcatgcctcggcctcccaagtagctgagattacaggtgcacgcccccatgcctggctaaaataatattcagtctaattttatatgtctacacacaaacacaccagtattccctcacattagaatattgttatattattttctattatttcaaaaacatcttattgaacacaaaacaaaatttttgtcatcattgtagacatgacaatgcaagcaaaaacatacttgaaattaaaaagaatcacactatgtatttttatacatgcaaggtgaattttgattaaagattaattatgttaaaaaatcttaatcatattaatactccaaactatcctaaataggcaggtaagtctcatttaagtctgatgcagctgttatttgtgaaactcatgttaatgttaatggttcactttctcaaaaaacagtatttgaaatgcctactatgtacctggagaaattcttggattacagcaatgaatcaaaaaagatagtctttgccctcacagaaattgcatgtaatataatgatccaaatattctctattctgagataaaaggtgctgacagttgtttgcagaaaaatattagccacaggcttgcatgtttaccttccatctgtcttctccctagagcatggcttcgtattcacaggcttacaaaattctgtctttttatatagggaattcttcttgttttctaaccactttgttaacatgaaaacaattatgtgctttactcatgtaataagatttacagaggatatttcttttacatattgttaaaatgttagtgctatctctgaacaactatatcacagaatgaagaaggcacatctttgtgtagtcttaattttaactaatagtcaataattgaaaaacccagaaataaattaatctctgattccttctaaagaaaacatatatataattataataatgttcacacagcttcctatcagtgttttacttgccaacaataataaagactttatacaaaatagtgatttttaatcagataaatatataaagttagcaatttaggattatgtgaaaggataataattatctgttaattttaaattgctggtattttagtcaactgaaaatctatcatgaatattagctgatttacctctcctgaaaaaaaaaatgaaagcaaggagtagcacacagttagtttttttaaaaaagtatgaacaagtatgaataaaaattatattttgtgagatttagctggaattttgaaattggctgaaataaaattgaaataattgcttttctcctgggattcaaaatagacttcaaaaaaaaaaaaaaaacagttttaactgaaacaaatctattcattgtgaaacattatttcaaatccatcagggtccaaggtgttaaaagaatattcaaataatacaaataaaacatttacttagcaaaactttcatacttgctatgcaatacagaatggaaattctaatagaggtatcaatggttcatcagtaacagaaaaacaaagaaaacatttgttataatagtgttccataaaacttactcatcgaaaagaaattttagactgattgtttctaagatttggtaaagtctcaagtgtagcatgaaaattaatcacttgggggatggagccaagatggccgagtaggaatagctctggtttacagttcccagcgtgagtgacgcagaagacaggtgatttctgcatttccatctgaggtaccgggttcatctcactagggagtgccagacagtgggtgcaggacagtgggtgcagcgcaccgtgcaccagccaaagcagggagaggcattgcttcactcaggaaactcaaggggtcagggaattccctttcctagtcaaagaaaggggtgacagatggcacctggaaaatcgggtcactcccaccttaatactgcacttttccaacgggcttaaaaaacggcacaccaggagattatatcccgcacatggctcggagggtcctatgcccatggagtctcgctgattgctagcacagcagtctgagatcaaactgtaaggcggcagacaggctgggggaggggcgctggccattgccgagttagttgtttgattaggtaaacaaagcagccaggaaactggaactcggtggagcccaccacagctcaaggaggcctgcggcctctgtaggctccacctctgggggcagggcacagacaaacaaaaagacagcagtaacctctgcagacttaaacgtccttgtctgacacctttgaagagagtagtggttctcccagcacgcagctggagatctgagaatgggcagactgcctccttaagtgggtccctgacctgcgagcagcctaactgggaggcatcccccagtaggggcagactgacacctcacacggtcgggtactcctctgagacaaaacttccagaggacccatcaggcagcagcatttgcagttcatgaaaatctgctgttctacagccaccgctgttctgcagccactgctgctgatacccaggcaaacagggtctggaggggacctctagcaaactccaacagacctgcagctgagggtcctaactgttagaaggaaaactaacaaacagaaaggacatccacaccaaaaatccatccgtacatcaccatcatcaaagaccaaaagcagacaaaaccacaaagatggggaaaaaacagagcagaaaaactggaaactctaaaaagcagagcgcctctcctcctccaaaggaatgcagttcctcaccagcaacggaacaaagctggatggagaatgctttgacgagctgagagaagaaggcttcagatgatcaaactactctgagctgacggagaatgactttgacgagttgagagaagaaggcttcagatgatcaactacgctgagctacaggaggaaattcaaaccaatggcaaacaagttaaaaactttgaaaaaaaaaattagatgaatgtataactagaataacaaatgcagagaagtgcttaaaggagctgatggagctgaaagccaaggctcgagaactacgtgaagaatgcagaagcctcaggagccgatgagatcaactggaagaaagggtatcagtgatggaagatgaaatgaatgaaatgaagcaagaagggaagtttagagaaaaaagaataaaaagaaacgaacaaagcctccaagaaatatgggactatgtgaaaagaccaaatctacgtctgactggtgtacctgaaagtgacggggagaatggaaccaagttggaaaacactctgcaggatattatccaggagaacttccccaacctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaagattgggttacccacaaagggaagctcatcagagtaacagcagatctctcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccccaaaagagctcctgaaggaagcactaaacatggaaaggaacaacaggtaccagccactgcaaaaacaggccaaattgtaaagacgatcaaggctaggaagaaactgcatgaactaacgagcaaaataaccagctaacatcataatgacatgatcaaattcacacataacaatattaactttaaatataaatgggctaaatgctccaattaaaagacacagactggcaaattggataaagagtcaagacccatcagtgtgctatattcaggaaacccatctcatgtgcagagacacacataggctcaaaataaagggatggaggaagatctaccaagcaaaaggaaaacaaaaaacggcaggagttgcaatcctagtctctgataaaacagactttaaaccaacaaacatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcatctctgcaccaagaggacctaatagacatctacagaactcttcaccccaaatcaacagaatatacatttttttcagcaccacaccacacctattccaaaattgaccacatagttggaagtaaagcactccccagcagatgtaaaagaacagaaattataacaaattgtctctcagaccacagtgcaatcaaactagaactcaagattaagaaactcactcaaaaccactcgactacatggaaactgaacaacctgctcctgaatgactactgggtacataatgaaatgaaggcagaaataaagatgttctttcaaaacaacgagaacaaagacgcaatataccagaatctctgggacacattcaaagcagtgtgtagagggaaatttatagcaccaaatgcccaaaagagaaagcaggaaagatccaaaattgacaccctaacatcacaattaaaagaactagaaaagcaagagcaaacacattcaaaagctagcagaaggcaagaaataactaaaatcagtgcagaactgaaggaaatagagacacaaaaaacccttcaaaaaattgatgaatccaagagctggttttttgaaaagatcaacaaaattgatagaccgctagcaagactaataaagaaaaaaagagagaagaatcaaatagacgcaataaaaatgataaaggggatatcaccaccgatcccacagaaatacaaactaccatcagagaatactacaaacacctctacgcaaataaactggaaaatctagaagaaatggataaattcctcaacacatacacccccccaagactaaaccaggaagaagttgaatctctgaatagaccaataacaggagctgaaattgtggcaataatcaatagcttaccaaccaaaaagagtccaggacaagacggattcacagccgaattctaccagaggtacaaggaggagctggtaccattccttctgaaattattccaatcaatagaaaaagagggaatcctccctaactcattttatgaggccagcatcatcctgataccaaagcctggcagagacgcaaccaaaaaagagaattttagaccaatatccttgatgaacattgatgcagaaatcctcaataaaatactggcaaaccaaatccagcagcacatcaaaaagcttatgcaccatgatcaagtgggcttcatccctgggatgcaaggctggttcaatatatgcaaatcaataaatgtaatccagcatataaacagatccaaagacaaaaatcacatgattatctcaatagatgcagaaaaggcctttgacaaaattcaacaatccttcatgctaaaaactctcaataaattaggtattgatgggacttatctcaaaataataagcgctatctatgacaaacccacagccaacatcatactgaatgggcaaaaactggaagcattccctttgaaaactggcacaagacagggatgccctctctcaccactcctattcaacatagtgttggaagttctggccagggcaatgaggcaggagaagaaaacaaagggtattcaattaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctagaaatctgacttacaagggacgtgaaggacctcttcaaggagaactacaaaccactgctcaatgaaataaaagaggatacaaacaaatggaagaacattccatgctcatggataggaagaatcaatattgtgaaaatggccatactgcccaaggtaatttatagattcaatgccatccccatcaagctatcaaggactttcttcacagaattggaaaaacctcctttaaagttcatatggaaccaaaaaagagcccgcatcaccaagtcaatcctaagccaaaacaacaaagctggaggcatcacgctacctgacttcaaactatgctgcaaggctacagtaaccaaaacagcatagtactggtaccaaaacagagatatagatcaatggaacagaacagagccctcagaaataaggccgcatatctacaactatctgatctttgacaaacctgacaaaaacaagtaatggggaaaggattccctatttaataaatggtgctggtacaactggctagccatatgtagaaagctgaaactggatcccttccttacaccttatacaaaaattaattcaagatggattaaagacttatatgttacacttaaagccataaaaaccctagaagaaaacctaggcaataccattcaggacatagtcatgggcaaggactttatgtctaaaacaccaaaagcaatggcaacaaaagccaaaattgacaaataggatctaattaaactaaagagcttctgcaaagcaaaagaaactaccatcagagtgaccaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggatataaacagacacttctcaaaagaagacatttatgcagccaaaaaacacatgaaaaaatgctcatcatcactggccatcagagaaatgcaaatcaaaaccacaatgagataccatctcacaccagttagaatagcaatcattaaaaagtcaggaaacaacaggtgctggagaggatgtggagaaacaggaacacttttacactgttggtgggactgtcaactagttcaaccattgtggaagtcagtgtggcgattcctcagggatctagaactagatataccatttgacccagccatcccattactggatatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacacggatgaaacgaaaacatcattctcagcaaactatcgcaaggacaaaaaaacaaacaccgcatgttctcactcataggtgggaattgaacaatgagaacacatggacacaggaaggggaacatcacattctggggactgttgtggggtggggggaggggggagggatagtattaggagatatacctaatgctaaatgatgagttaatgggtgcagtacaccaacatggcacatgtatacatatgtaacaaacctgcacattgtgcacatgtaccctaaaacttaaagcataataataataaaacaaaatagaaaattaatcacttactgtttttaagtcatttataatatttactctgactgttgtcaataagatccctcatatctctaaataaacccttttaaagatactgaataaactccttagagaatactgatgggatgctatttgctattttctcacaaataatgctcactccttgcctgtcccgaagtattaagataaaaccaagcacattaatcaattttcaccaaaatatattcaataaagaagatcattttatcaagcaaagtaaatatatttgtaaggatttatctgaaatgtgaagctgctactattgaatcttccctctttattaatgattttttaaaagagaatgtaatataacaaaaatcacttattaattttgatggtaccacactatgaaattttctgacactaagtattactttccaatagaaatcatcacattcatattgacctttggtatgactgtaataatcctctactttgtgttaaatgaggcagtgataccactgagccaaattgaatgacttaatgcattttctgattttttctgagtaaaatatatttttaaataataaagttggccgggcgtggtggctcatgcctgtaatcccagcactttgggaggccgaggcgggtggatcacgaggtcaggagatcgagaccaccctggctaacacggtggaaccccatctctactaaagtacaaaaaattagccaggcatggtggtgggtgcatgtggtcctagctactcgggaggctgaggcaggagaatggcgtgaacctgggaggctgagcttgcagtgagccaagatcacgccgctgcattccagcctgagtgacagagtgagaatccatctcaaaaaaaaaaaaaaaaaaaaaaaggaataaaattatctgtgattgtgaacaaacatctacacacagttgtgaatttgaatttttaattatgcgctgctatgacattgagtgatgaaaaaagaattattctttgtaaattatatgttactagatgaggtcaccatcaactgatttgttggcaaatcaattaaaaagtcaaaaacatttttgactaatctacatacattcaatcaacatccatcttctctatttcaatcacatatgctctttctcatcttctccagctatcttcttgccatttcttaaacttatcagcatattcatcttcagagtctttgaatttattcctctgtctataatgtaaattccctggatgaatgcatggctcacatcttcagtcttaactttatgcagttttgctctaatgtaatttcctcaaagaaacaagtcgtctatctgaaacagcatcactgcctcctcagttgttaatcacaccttggtttcttgctctgtttcgtttttactccctgtctctatctccatgtggaaagtggttttgcctgttttcttctctgatgcatcgccagtaccagaacagattctcacacaatatagagtgtcaataatcataccttgaagaaataactaagcaaacaaatgattaatgaaatgactgattgaacaacaaaattatgtattgggcatgtgttcaagattgtttgtaacagggaaggagagaattgcaagcaggtggtctttacttacattctatttcagctgttttgttgtaaaaatgaagacaaatttgggagaataattttaatactaaactttgactaggaactattgtctttcttactcaaaaccaacttaagaagcaacactctcaaccacacccaggtctgacaactcaaagcactgctctgtaaaattgtaaattttcaaaagcaaacacacaaatgacagtaaaagcaatatcatagtttccaatgtgtcctgaggtacatgaaaagagcttagtgctaaccaggtcagcatttttggaatgagaaccaaggattactgtatgacaaaatggagaatctagaaagcaaaaacttggatcaataataaacaaaatcttgattcttgacatcaatggcaagttgctttggtggattttttaaaaaagcactcaatatattagtatatatctacattttgttgaataaacccatttgaatttaaccaaaagtagtgtactttaacagtgcgtagattataacaatttcataaaaattttatattgagtatacttaacagattcatttctattcatactgaaaagtaattatacattctttgcttaaactacactacctgatataaatataaaataaatgctcattttagtatatatgtcaaatttgtatgaagtagtcatagatgaagggatagcaagtactttcatgttctttaaatcacatgacatacttacatttagttgaattacataagtaattcaatttaggaatacttggcatttgaatatttgttttgaaaactgctgtaggaaatattttaagtccaaaatattttcaagatagtttttgaattactatttatatctagcaattgctaagaaactttatactgttgattactgcactctattcaaaagtgaaggtagtgatcagattttcagtgtcttaacagggaagaaactcacagtccaattgtctcagcaacacaaatccgaagtctaacagtcaatatttgatcataaggaatggaagaaatgaaataactgtttacggcaaaaggaaatttagagaagaaaggccttaaagacagggaatggtaaaatctaagacctcaagagagcccgtgtaaggaagagaggatggagaaatactgcttaggaaagttctgtacaaagaaaatcttcatgacctttatttcaaagccagtaattgaactttggtgcttcctcccctcttacatcgataaatttccacaagcaactcactccccaaataacttttaaaaaattatacaatctaaatgtaaacttcttcattgagtccatcatggcatccttggttgatgttgctttcaaattatggagacaactcagatttacctttcatttcccaaatttactgagagtgtacaatatattttaaactttaaattcatgaagctccttcagggtgggttttctaatctctcacgtagtgatatccttttgtctctgcatctgtccatttctgtacagtcacagtggtgtgttccaaccatgacttaaaatcattttctccttctctttacgtagcagtgcctgtacacttcggcagattctgagaattagtttgaatgagtggttccaaagtatgtttaatgtcaatctatagttgctgtaaagcagccaaggactctgatgtggctggcactcagtggcaggtctttaagtagtcccagagtaactgtccccacctctcttctttcagtaaggcttcaatgctataagcaacttagagtcaagagaaactagaaaatatctgttcagaaaggtattttagacattctcacttaattaaacatagataatgtgatctgtttctctaaatccattctcccctcaaaatgaaattacatactaaatacgctctacatgctagttcaagagctttctggtggtagtcaggaactaacatatctctttgtgtgtccactttgcccctttacaacgtaagcttagtattaccagcaattgtgatgaaaataatctcttgttcagcccaagatgatgtaatgaatctgtcattaaggtgctgttgaggacaaagatcaggaattgaaagcatctaacagagcccaggatgagaaagaagtttatggatctctgcctgttaaattcataattcttccaagcatgcacatatgtataaatgcacttgacatatatattcacaaagaatatttctgtcccacaaattataaaagtctttgagagatagagacatgtgtataaataagtgttctataaatgtagctcaatgacttacataaacaattagctataatttaaaaaatgagctatttagatgctttgctttagtagtgaatgtatttagatatagagattatttagcaatagacatcagttaagtgagccacaggcaatttgacttcaagtaaatttactaatttagctgattaaagatttgttaggcctttcttttcaaagaagcttcaaagcctttaaaaatgagtgctcatcattctggtaaaataggaaacccacatgttttattactaccaattaaaagatactggaaaggagaaattaagagagtatagagcaaggctaaaaataagtatttcttttctttctttttttcagacaggatctcactctgccacccatgcttcagtgcagtggaatgatctcagcttactacaacctcccctcctggcctcccaggttcaagtgattctcgtgcctcagcctcccaagtagctgggactgtgagtgtgtgccaccacacctggctaatttttgcatttttagtagaaacagggtcttgccatgttggccaggctggccttgaactcccgagctctagcaatccagctgcctcagcctcccaaaatgctgggactacaggcatgagccacccaacatggccaaaaataattgtgtcattgggaagttttgattgcctaaagaaaaatataaaaacatttgcatggattgtttcccttagatttttaagacaaaaatgattaaagcactacattataatatctggcagaggttcatttgatcaccatatttttagaaatttaatgcaaaagagaaatgcaaaacatttactctctagatcagtatttatacttcttgtgatgacttaaataactctggcagctttctgagtagttggcagtttctacaaaatatgccaagtaaggagcacaacattagtatactatatcatgtcattttcttctaaaacacaaatattgaacttttaccacctgctactgtacagcagtgctatggcaacatcttcgtagagttcctaagctcctttgaaaagtaggatctaatcagcacaaaaggaaataaactatcatcattgctgttgctataattacctagttggcaaaataagctctatctatacagaatcacacattaaaacaaatttgcttaggaaaactaaatgttttatttcagcccagcttacattttcaaatgaattggttaacaattagaaaagaaattgttgataaaccttgcattatgtttattgaatttttatttctggttaaaaaggttaactgttttcactgtggaatatttagaaaatatagatttctttctttaaaaatagttagccataaggaagccataattcatcactgtaacagagaatcttttttcatatatcttttactttatagtattttaatattttttctctactgtagacacatttgggatttatttccaacttacataaatgcatcataataactgtaactccatatgattttattatgaataaggatagattttaaaaacataatcaaaatgttcacatttttgtaattacttaatgtggcaaatattttattaatacttaaatttgtttaatcagaggccagcagtactgtagatatttctgagtgatttcacagaatgtgtgggaatatacatctgcgtcaattctttaaatgagtaaaaggagcatctgtaatgcagcaaaatcaatcatgaagaagtaactgatgcaggaattgcctatacaggtttccaaagtacatgtacgcgtgtagattgagttacaagaaaaaggtcactttctaataaggcaactgacaattattttgtaaaaaatatgaaagtgcaagcacatactttagaacaaatattaggtacaagcttaatggaagagtctatcatgtaattagcagacaaaatgagccacagaccacatttacatacttagtttaaaatagaaacagagtcccaagagataaccattttactgctgcccagttgaggagaaaacactttcaatatttctacattaacgttcagagagtcaaggtggccgatgcagaacaaaaacactaatgataaggaaaaaaagtttttccaaagaagaacttggtatgaattagatattaattgttaattacttcagaaggcccaagtgaaaattcagacttctttctctgctcttggccttatttcatgttcccgctttctaagcacattaggttttcctattaatcagtcacaatcaccatgtctaatcggctgtggatctagatccttaccagatcccagccaatagaagttagcaatgtaaggcttattttgtggaccacttctttggaggaatacgttgtgtttctgttagatgactatacacatgatagtcaacttccagcccatatctggatgcattcttgagatgactctgaatcaaataatttcttttaaaccaaaactaaatatttatattaattgaatgagacttttataaattattccaagtaaagcatgaatttccagagactggcataatttaaacccatactggaggggaattatccatggatttgggttgaaactttcattttagtacctctactcatagtagattgagaattaaaatctgaagaaaaccctcttagataagacatttgtaaaataaaaaactcacttaccattccgactttcttcatcaatagcaactatggtagctggtggtcctcccctagctagtttgcaatctaaagagagaaaataaccaaaagtaataattgactgcaggggcacacacaatgagaaaaaaattcattgagatgtatattaatatttaaaaaggaaaatcttgcaatctaattaatatgcatcactacaattaatattatttaaaaacattttataataaccacatagattccttaccacatcataatacagtcactttgtgcatcacaaaactactcaaatcttactgagaaaacaccagcagggaccactggagagcagaagtccttcaggacagagataatgggatggaaatttaacccaaagaaataacagaaagggatgattaacaaggataaattgtaattaaagcatcacaacagaaacaaacataattggactttaattgtgataaagggtctaattagagagagtgaatagaattttaataatgttctaaagagaataaaacaaagacagacaagcaatgctcatgaggttgtttggggtttttatttttgtcatcttaccctcatattgccagtctggagtcaaaagtatagagtcatcaatggaagcagatcagaaaaatggaagaaagaaaggaagagagaatatatgtatatatttagtgagagatttaaggatataaaaagcattatacaataacattatctaatgatttgtggaaatagaatatataaaatccctatcagatttcctacttctaatataatgttaacacattcactggataatacacatcattagcattttaaaagccgttacaaaaaagactagaaaataacataaagtaaattggtatttttcttacgaaaaggtaaatacgaattacttatgaacagtctgttatctgtatgctgaaaaaactttaagaatagtgcctgtcaatcagtagtgatgattaattcattatttcaaacactgctaatatccttccaggtatcacatgataatgaacataaaaaatagtatgagctataatatccatgacagttgaaatgtgaaaactttgcctgcaggatgtcaaatgtgcacctctgagacataaagtactctactaggaaatactttgtgaggcagagagggctatgtcatgcagttatacatacatggcacactcctgtacagcagtgcaaattaattttgcttgaagttttccaaatttgtgtgttatttgggaaataatttcaaggtttatttacttattaaaattctgccatttattatgtacatatacatgaataattaggccttcaggaagcactattctgtattgtaaggtatgtacgctctcatatgaagcaaagaagctgggagatctacacattttctctctttacacttgtcaatattgaaggagttccaagtcataacattttcagatctaaaatatctcacactcattacgcctcttcctctccttatgccctcctacagagcccagcactacactatttgtcatctctgctcttgatttagtttcctcgctgatctcccagaagtcttgttctcatcctgcattcatctattcctttcatgagaatgattttcatgtacccaaatcaaaagtgaaataatagcattcctctgaacaaaaaccttacatgtttcttttggagaaaatgaaaaaaaaatcagaagaacaaagtttcttcacatggccttaacatcctttattgagaattaagcaacctgtccttcaattacatgaatcctcttactgttgctggaatgtagcctgtatttttagcaaaattttgttatctaaattcattgttgcctttttttgcctagcaaatctctgcttctttttgtagaattagatatttcacatatttgcacctagtgcgaattaattttgattaaagccttccaaattttcatgttacttgaaaaatgatttcaacatttctttatttatttactgttttataaaattcctccaattattatgtacatagaaatgaataattaggctttggaaagcactgtattgtaaggtatgcactctctcatatgtacacacacacacatatacacacactcatgtcactgtgtgccaatgccataatacctactgaaaatagataaaaattatgtattttagtgtgaatgttggtagaggaataaatatttaatcaacaactttatgggcaagcagaatatagaataataaaagaaggggaaatttggatataaatatttttgaacctttttacagtttgttactattaagtttaaaagtaggctttatgaagctaagccaaataatatcttcatattccagcccttcctcactctccgcctttcccattctcaaagttaattctccattcataccaaaccaaatttatgttttttgcatcaactgttaaaatatactttccactcttcttcccctggttaattttattcctttttcaggaatctgcctacgcatcacctcttcttgaaaatccttctcgttgtcattctagattaagtccttattctctgtattcctgcagtacacactgtatcccattggactaattgccccattggcacaatactaatgtgtctttctctctcacaagagcttcttcagaccatgcctgcatcattttcaccttggtaacctcagaacatgatactggtcctgaaagaatgtttgttgactttttccacaatgtagtctgctaagctacaatcttccattaaaacctctccatgagagcagctcagaagtctctgttctcactaacccctcaatagcagaaacagcccagaagaagctgcttaactacattttctcctgctacagtacccttagataattcccactacgatttattattttagtagattcaaaattctccccaataaaacattctttatatactacatatacttctggataaatacaaaaataatttaaacttttttaagactcaaaacacaaaatgaaaagaggttaagcagacacataataaataatctattaataacattgttcataacaaagtgtttgtttttaaacgatgcattcacgacagcataattaattagttttgaagtgcacaaaagcatttttaataagaacaattatatttagaattgtcttggaaagaaagtaatttggatgtaatagccaactatatattatgtatgaaaatatccaaatgtaaatcaaagggaagactagaaagcaatttgggggatggggagattgtaccctatggtctgtggatcatctgtctgccacaggaaagtcaggtgagctgctgatacctgtaccctggaaatggacttccttaatctatttaatttcacccttgactgtcctggttaaatcacaaattcattgtttttcatgcctaaagtttctagcctgttaggcctatactcattttccatatccaatttgtggtaaagtacaggatatgaataccaataactgaatgctcagtgtggcttatttctgcaaacttgtcacaatgctaaaaataagccatatatttaaaaatattcatatgcaatagatgggatttaaaatccaaagaggagaattaaaaagacaaataatgactgatctcacagatactaagcctgtgatactctgttgtcattgtagcctgaattttaagagcatgttacagacaggtcagacaaaggcttttgaaaatctaggattttccgaatatgctcatttcgtagaaatgagagcaagcacccaggaattcaaattctattcccactttagcctattctcaaaatgttcttttaacgttgatcaatgtgttttcaataagacttcaaaactatttactttaaaaaatatattaacatagtaattgcccttatatgttaataacttgtgtattgaatttcctacccatatttatcttctgagcctgggtcccatttgcccagacaacttctgtacttgcaatttcaaagttgtcttaaatgtagccctccaaatcgcatcccagttgctatcatagccgaaaactggatattttcaatatatattatttcagtgaatggcataattctgcaccaagccacataagtcagaaaccaggaagtcacatttcattttacccatgtttctagctttccaaaatgtaccgatcgataagtcttgaatttaattcctaaagaaaaacttgtcatatccactcactgctttcaatctgcagtggtaccaggctaatcttgtctcttacctaatcaaataggttttcctaactgctttccttacaatcaatcttgcccttactctgagttaattttctgtctttaagcagagtgatctttataattaaaaccttgcttatttttaaaagaatttaccatttattttaggttataagctaaaatattttggccatctacaactcatcacaaatatgattctagaatgtaaactaacatattttatataacctacaaagtcctccacaatatgccttctccttccctctccagtctcatctatttccatgtccctcttttcccaaagcaaaatagtttttgatcccttgactaggtaaggtttcccaatatatactctcataactctgcctcataatatcaatttatgattacttgattcttcacagaaagaaaactcagtgataacattgaccttgtttctattcctcacggttgtgtccacagggcagattttcctggcacatttttgattccaagcaattatttactgaatgcaaaaacaaagggcctcaatcaaatttgtaacaataaaattaaaacaacactctgtacattaattcccttttttctttttaatttttcaaatgtctttctcaagtgcaagtacagcaggtccttgaatgacattgtttcattcaatgtcatttcattataacaatgaaaaaaaaaaacaactaattccaggcctgagccactatctgtgtggattttgcaagttctccccaaatctgtgaggactttccctgagtactccagtctcctcccacatctcaaagatgtacatgctaggttcattggcatggctacatggtaccagtgtgagtgagtgtgggtgtgtgtgtgagttgccctgagaaggaatggtatcctgtccaaggtgggttcctgccttatgccctgaggtactgggctagcaggctccctgatgggaggccctgaactggtaaataattatctcactttttttgattaatctttcttaaatgcatgtatagctcacatttacttcaatatttaatataagaaatttttggtctttatttagaagtgtggtgatgtttttgtaaccataactatgtcataggaacttgtttatattttgtttagcctaaaataaaattggtttcattttatgtcatttcattgaaagtctcaatttccaagaacctacggacaatattaactgaagacttactgtaatgaggaaaaaattgacagataatttgttgtctaaagataaggtcattggtgacaactcagcagatgtgaaaggctaccaataaagtaagaaaggtgtagataattctgcaagaatttgaggttatttggaacaagttatgaaagattagagagagctcacaataatagacaaagtaaagtgatgaaaaaaaaggagaaaatgttcacttgcttccaaatgtctataatttctattagaattccaagatgttttatgattttaccaaactgtatcttaaaggaataaaactaagaaatttcaaatactaaagtttaaattatatcaaagatcaacttaccttttttttgtcatcttagaatttttaagctatttccttacaagctgcctaaatcaccagtgaactctgtggcacctagtagagtatttgacttaacataatcatttaatttatttgctgaattaggaaatatcttcctctatggaaaattaacaaaatgaataatccatcaaatccttagctttaaccatttcaaatctttgggggagtgttttaagatgttaaagaaatgggtttctaatatattatagtggttgtgaacatgtgctttggagtcacaaaacctaacttcaaatcctaactttggtttttaatagttgtataatattggacaaattatttaacctcttgtatttcattaatggggataagagtaattacaactaactcatatatttttacaacaaggacaaaatgaggaaatctatggtaatttcttagaagagtgtctggcaaaatgtatagacagactaggcctacatttgcttttattagtatccttattttcattaggaatatattcgaataaaatgttttttctatttttttcctttcatgcaagggctgatagtaaatatagtaaataaaccctcagctctcccaaatattcagtgagggcagatcttagttatatatgggattgtgaaatatattgttattaagaataaaagtaattacatgaaatgtcactggtggtctgtagggacaaaaatttgcttgaattcctatcccagataccaagctagatatactctgatggattaaatttactagggaaaaatagactccttgaacttgaagcttaaaaaaagtaatggggttctcacagtcctctactggtcccagtatgcccctgatatgagttggtgagattccacagaaagatcaaggaagagttgcagattttgtgaaacctctattcctgccaacatttctctattatctgtttcgttattcagagtaatctagtctcttgctcatgtgtttgtatttacacagacacacacacacactgaatctattgctaagttcaaagcaatttggcacctcattcaaagaaggtactgtgttctctttaaatttcatgctacacaagcattctgttttcaatttgcatgtcacaagcagcaggagagggacttttctcatttttcctgttgatctttggtatattcattttcaggaaaatacacacaggagtgaaatcttaagacagatactacttattttacattttgactgcttcatccaaaagaaaaagtttgatcttgaatttataaaatcaatggaacaataatctaacttgtatgatctaaagttacagtcaacaaactaatggaaaaagacaatgatagaacaaaagcaaaataaactgagtaaatttaaggacagagcaagtaattcagttccaattcaagaacaggatatgctacttgtgttactctcttggcattactatttgcagatttcagatttcaccatgaagggagcaaatgatattttatgtaccttagtgtcattattaattgaattatataatttgatgaagactttaaaacaacattgtctagtaatatccaccaaattcattcatggtaattactcaacatcattgctttcatcaatacaatttactctagagaccatagctacctcaatctgtacttttaaaaaaaacaatttcttattattttattttattctaactggtctatcaacaacagcagacttgaacataaatggcatttggtcagagaccagaagcccatacttagtcttaagaagtttggccggatgcggtggctcacgcctgtaatcccagcactttgggaggccgagacaggcggatcacaaggtcaggagatcgagaccatcctggctaacatggtgaaaccccatctctactaaaaatacaaaaaattagctgggcgtggtggcgggcgcctgtagtcccagctattcgggaggctgaggcaggagaatggcatgaacccaggaggtggagcttgcagtgagctgagatggtgccactgcactccagcctggcagacagagcgagactccacctcaaaaaaaaaaaaaaaaaaaaaaaaagaagtttaaggttctaggggctttaggaaaaaggcagaatatgaaataaattgtcagtagaaggctgctccaaagatgaagtatataattttaagattgcttttgttgattgaaaatattattgtactttattttatagttttatgtaaatacattgtcaaaacatgttaatctttgtattcatacataattctcttacatataattcataccacatgagttagaaactgtttaggttttccttccattgtgggttacaactcttcttttcttgtctaagcttccagcaagcaaccatgattcaatttgaggaatttaagatgaacagaacaattcttggtccaaggtgtaatattaccactgacatcaaaagaggccatataatgttgtggttaagaacatagcctttgagacagactgcctaggttaaatactagtcacatttaacaccttgctcactcttaggacctttgaaagttaattaaattttctgtagctcagttgcattatttgtaaaatagatgttgttttagagtagtgtctggcatatggaaatgctttctatgttattgtgaggtaaatttttattctaaccaagtgagcaaatcacttaaaatatgtctgttttttaaaaagcaatgactgtcatttttttttttaatatttcagtagaagtttcttccatttttaacattcaaaggaaaaccacattttattagtagatcaaataaggaatggggcatatgttaactttttaaaaaataatttcaaattttcttttatatttaggaggtatacaatatgcaggttgttatctgggtatactgtaaggtttgggatatgattgattccatcatcaggtaatgagcacagcactcaatagttgttttttaaatacttgtccctcttccaccctctccccttttctagatgtccagtgtctattactgacatccttatgcccatggctatgcaatgtttagctgctacatataagtgagaacatgaattatttggtttttctgttcctgtgttaacttgcttaggataacagcctataactgcatccgtgtggctgcaaacaacatgatttcattctatttttatggctgcatagaattctatggtgcatgtgcagcacgtttcctttatccaattcactgttgacgggcacttacattgaatccatgtctttgttattgtgaatagtactgcaatgaacatacaagtgcatgtgactatttggtggaacaatttgtttcctttttttttttttttttttttgagacggcgtctctctctcgcccaggctggagtgcagtggtgcgatctcagctcactgcaagctccgcctcccaggttcacgccagtcttctgcctcagcctcccgagtagctgggactacaggcgcccgctaccatgcccagctaatttttttgtattttcagtagagacggggtttcaccgtgttagccaggatggtcgcgatctcctgaccttgtgatccgcccgcctcggcctcccaaaatgctgggattacaggcctgagccaacgcgaccggccgcaatttgttttcttttagatatataaccagtaataggattgtgagtctaatagaagagctggtatcaagtctgaaactactctaaaatatcaaggaggagagtctgctccctaactcattctacaataccagcatcaccctgataccaaaacctgtcgaagacacaaggaacaaagaaaactataggtcaatattcctgatgaacatagatgcaaaaatcttcaacaaaatacttccaaggcaaataaagctgcacataaaaaacttaatctaccattatcaagtaggcttcattcctaggatgcaagattggttcaatgtatgcaattcaataattgtgatttatcacatggacaaaattaaaaccaaaaaccataaggtttttgagaatctccaaatttccacattggctgaactaatttacattcccaccaagagtatacaagcattcccttctctgtgcagcattaccagcatcttttgttttttgacttcttaataatagcattttgactggtgtgaggtagtatctcattgtggttttgatttgcgtttctctgatgattagtgatgttgagcattttttcatgtttgttgtctgcttgtatgtctgtttttgagagaagtctgttcatgtcttttgccaatttttcaatgtggttatttggtttatgtttgttaaattatttaagtttcttatagattctggagattagacctttgcgggtgcatagtttgaaaatactttctaccattgtgtaggttgtatttttactctgttaatagtcttttctgtcgggcagaagctctttagtttatgtaggtcccacttgtcaatttttggttttgttgcaattgcttttgaggacttgccataaattctttgtaaatgcaaacatcaaggatagtgtttcctaggcttccttttaagattcttacagcttgaggtcttacacttaaacttttaatgcatgttgagttaatttttgtagatagtgaaagtaagggtccagtttaattctgtatgtggctagccagttaactcagcaccatttgttgaatagggggtactttccccattccttatttttgtcaattttgtcaaaaatcagatgattgtaggtatgtggctttctttttggattctcttttctgtttcattggtctatgtgtctattttgtaccaataacatgttttgttaccagtactatagccttagagtatagtttgaaaaaaagctatgttgtttttgcttaggattgtgctttggtttgaacttgtgtccccatccaaatctcatgtcaaattctaacctccaatgttggaggaggggctggtgggataaaactggatcatgggtgtaggatttgcccttgctgttcttgtgatagtgagtgaattcacacaagatctggttgttttgaagtatgtagtaccttccccttcattctcttcctcctactttggccatgtccccagccatgcttcctgtacagcctgtggaaccaagggccaattaaacctcttttctttataaattacccagtctcaggtagttctttataatgatgcaacaatgaactactacagattgctttgtctatttgggttctttttggttccatatgaatttcagaattttttctaattctgtgtaaaatggcattgaaagttcagtagcaatagcattgaatctcttgattgctttagagattatggcaattttaacaatattgattcttccagtcaatgagtatgaaatgctttttccatttgtttatgttatctatgatttctttcagcagtgtgcagttctccttacagaggtctttcagcttcttggttagacgtactatctaaaagccctacttaaaaggcacagagtgatgggttggataaagtaacacccattcatctggtatcttcaagagacgcttctcacatgtaatgatccccataggctcaaagtaaagggctggagaaagatctatcatgcaaacagaataccaaatggaacaagggtcactattgttatatcaaataaaacagcttttaaaccaacaacaataaaaaagaacaaagaagggcattacataatgataaagggttcaattcaaagacaagacttagttatgctaactatatacatatgcaatattagagcatccaaattcatgaaacaaggacttctaaacctacaaaaagactgacatagcacacaatgatagtgggggtcttcaacaccccactgacaacattagacaaatcattgagtcagaaaacttccgcagaaattctggaattaaatttgacacttgacaaattgagcataattgatgtttacaggacactccatatatcaaccacagaatatacattcctctcatctgcacacagaatatactctaagatcaaccacatggttagccataaagcaagttggaaaaaatccaaaagaaggtctttccataaaacaagtctcaaagaaatcaaagttataccaatcacataccaaccacagtggaattaaaatagaaacctataacaagaatatctctcaaaaacacacaaatatatagaaattaagcaactttgctcctgaatgagttttggattgtaaggcagaaattttaaaaaattcttttaaataaatgaagaaagacacgcaaaataccaacatctctgggatgtgggaagagatatgttaagaggaaagtgtatggtgctaaatgcctaccttaaaaagttagaaaaatctctgattaacgatctaacaccacatctagagtaactagaaaaacaagaacaaactaactcaaaagctacctgaagaaaataaataactaaaatcagggcaggactaaataaaattgaggcataaaaatccataaaagcatcagcaaaaccaaaagttggttgtttgaaaggacgaataagatctatagaccactgactatatgactatataaacaaagaacaaaacagagaagatccagataagcacaacataaatgacaaagatgacattacaactggtccaacagaaacacaaaaaaatcctcagagactattatcaacacctgtgttcacacaaactagaaaatatacaggaaatggatatattcctggaaacacacaatctcccaaaatttaatcaggaagaaattaaaaccctgaacagaccaacattgagttccatattgactcagtaataagaaacctaccaacgaacaaaagccccacaccagatgaactcacagccgaattctaccagatgtacaaagaagagctggtaccaaatctactaaaactattccaaaatatcaaggaggagagactcctccctaactcattctacaatgccagcattaccctgataccaaaacctgttaaagacacaaggaacaaagaaaactataggtcaatattcctgatgaacatagatgcaaaaatcttcaacaaaatactttcaaaccaaataaagctgcacataaaaaacttaatctaccattatcaagtaggcttcattcctaggatgcaagattggttcaatatatgcaattcaataaatgtgattcatcacataaacaaaattaaaaccaaaaactatacgataatcccagtagatgcagaaaaagctttcaataaaatccaacatctcttcatgataaaaatcctcaacaaactctgtatcaagggaacatatctcaaaataataggagccatatatgacacaatacagctaacattaaactaaatgtcgcaaaagctggaaccattccccttaagcactggaacaagacaaggataccattctccattctcaccacttctatttgacatagtactagaagtcctaactacagcattcaggcaagagaaagaaagaaaatgtacccaaacacgaaactaaagaagtcaaactatctcttctataaccaggaaacctcgatgacatcaccaaaaagctcctgaaactgataaatggcttcagtatagtttgaggatacaaattcaatctataaaaatatattaacatttttgatgtgcatttaacatactaaaatcatgacttaatatatttcagtatataaccaccgattgtttaaattacatagtgataatggaactatactttctttttaaaaattatctgaggaatgtttataaataaactaaaaataaacaactcttttttgatacatacagtagacagtatacagcttctaaaagctctttacatggtgaaataagatctgttattccaaaatctttccaaaagaacttttctgttattagcttgtttttcaacattatccaacttgtctctgtgttttgtaattgaaatataaaggagaaaggaaaaggataatatttgtgtccatgtggaaaacaaaattattcatcaaacactttatgaaaagcagcttttatttccatcttgtttctgaaagctaatttgttattttttctaattattcttaatgaggaggctcagaggaaattcttaatcatgattcttactaagacactcaacaaggtcaaaagataaaagctgcagaatcaatgtcactgtttaaaattacactcttccaacagagagattcttaataagtctttgtttgcagagtactttgactactaaataaaattctttgccacaagacagttatgtgtacttaagctgcattaaaaaaagcaaactgtatggattaatttttgaaacaaaaattataagcatttaattacttattaaagaacatatccatgtaaatatgtccttagctgtccagttgtgacagatgttagcatgaaatagatgtgccacatttacaaggtacgggatgttgaagcaattttcctacttaagtgaagtaatataggcttatatttctggaacttcagaagactgtgctaatatttacctttctgtttcatcatctaggatataactatttttcacttatgtgtgaagcaggaaagttgttagacatagcaggaaaaagtacttcgtatcactggctggcagagaaagtttatatatttgagtttatacaggtaactggaaatttagaagtatttttcattgccttattttcttattccttgtcatgaagagtgtttggactgaggttctactatgaaaggtgaatatccaagggtggaatgagtagggactgtggctgagagttatgaaagaagatgattctgaaaaaaataacagaaagcataaagcaaatatttcctactttttccatacatcacatcttgctttctcagaaatttctctgctacaaacccacctgataacaccttccttagagccatagagccaaagtcattacagaggaatgtttcatatagaacaggaagttccaaatgaacctatgttctttttgatacgggagtactgggaagggaagagcgtggtccctttaaatgacatggaagggggaaagggaagtgctgagtggagaagggcgtggtccctggctagggctccataggtgaagactggcgctcctgcttttgtgcccaaatgttgcattttccaagaccaccctggcctgccatgcccccatcctgggcctataaaaagccaagaccctagcaggcagatacaaatacaggtggatgtggtgaggaacacattggcagaagacataagcggctcctagactccaaaaggatgtcgagggagcacaccagcggaagagcacaccgacagacactggcacgcgtgcaggccacccactggtggaaggaggcggagtttggtccggggaagttggaggagagccgtggccccccaaaactccgaatggcccactccaagggaaaaccatctcccttctggctcccccattggctgagagctacttccactcaataaaactttgcagttgttctccaagcccacgtgtgatccgattcttccagtacaccaaggcaagaaaccccgggatacagaaatccctctgtccttgtgataaggaagggggtctaattaagctggttaacacaaatcgcctatagatggcaaactaaaacacatgccctgtaacacatgcctactgggccttcatccctagacactggggtcagagccccacatcctgcccatttgcatgctcccctagaggtttgagcagcggggcactgaagaagcgatccacacccccaacgcatgccctgcgaggaggacaagggaacctttcccatttcgttttcattgtttcacaataaagaagtgacaagggatggatgtctacctatgtcaactgtttttaaaaataatatttcatgtaatgaactggcctatgaaatttgatcatatgatttggatcattcttgtcacacccaattaaaagaaagttgactagccaggggaaaaaaaatcaggacatgtagcatcgctctagaaacgtaattttctgcaagtctggctgttgaaactgcctattctaacccgagacagttttatttataactgctgagacaacttgcaactccagggctaattttccccaccgctgttgctcaccaaacagagtttgccagctccccagaaacttactagtcccaatgcactttctctaagagcaatacataacatttctcatttttataaaatcaccaaccttctctttgttcttcagacataccgaagaacacctgacccgtgtgtatgctccaaattgtgattctttattctcaaagaaaacattgaatttagagatccatctccacatttctattttgacttcaacaatcccattctgcatcataaaccttgagagaataatatccaaaccaagtcagatcagtaatttgatctgacatttcttggggtgaaagaaaacttttgttggcaagtttagcaaaagggactttggccacatgctgaagtatgcatatgtacaaatgaattacttcaaggaaaatgagctaggataacagtttttatattggccataaggataaaaacacattattgattaactgcattttttggagcttggaagttttcttaagaattctctaaaactgaatataataaagtgctaagacaagtattttaccacccttgacatttagaaatgaagtttttgatagtttgttatccacatgtataacatatgatgtggaaagttttatgtcctgctgagcttagttctcataggctcaattttagacaatttctatacagacgcctgcaattttgaatatctgctgctatttatgaggccttcccaagggtggtactccatatttaatttaattgtgtttgcatatatcatacattttgccaacagtaagctctaagagcactttatagttgataacaacttccttcattgctttccaagctatatgatttcttactataaaaccagccttccaccttcagtattgttagttctaacggcatacacgcaatggttttctctactatgttcaaaaagagggtaaaactactaagagtggaaattaatctgttaaaaatttctgttacattaacagcattttattatatctctcctcaaattaatttacttgagtacagtgctagaattgttattctgttgttagactttatgccataaattttggtaatatgtctatcatcaggaggttgggattttcaaaatttttcaattatcataatcagagacaagacctaggaaatgagatcaatttagtccctctaatcacaaatgtctgtactctaaagttcatgaacttgacactaagggaaagccccagaatggattagaaaatgctaataaaagtggagaatgtgtgggaaaaaaagacacctggctaaaggaaggcatgtttccaattttagagcaaggacagagaaatttttacagtagatataagaattcacaaagcatagctgtctggagcaaataatgtctttctctactaaaatagcttcaatactactttgttgcagattgtactaattaacagttatgttaatgatggtaactcatcatcacaatttttattttatgcaaactctttaaataatagaaaagtatgcaatgtattttagaaagatttgtatccatggaacttataaccaaaacaaatgttaattaaaataaagtaatatttttcttctgtcaaattgtcaaaattttattaaaaataatagccactattggttcaagtaaggaattaaaattattttataattttggtgtagctataagttgtttctatataaagaaagaaaggagagaaagcaaggaaggagggaaggaaggaaggaagagaaagaagacaaaatggaaagccaatataccaagaacttttaaaaactgtcctttgaatgaaaaattttactttgggatctatagcaatatagagataattaaagaagtatatattgctgctaaaagtacttataatagtaaaacattatatatgtttattaaatcattatgatttaaacacactctgtaattgtgacagatactgtatattggaccacccactctaacacctcttcttgtatttttctttttgtgcactattgaggcagataaacttaaaactgcacttgccagactcatttgcggatagggtctaccttggaatctgcgaagcagaagacactctcatgacacaagaacataaaggaacaagtgagccaaagggaagtcagttaatcactgggcaggaagtgtatggttctttgggggcagctgtggtagagaaattagtgcaacaccaggttatgatagttgccatgatggggattgtacctatgaggtttccactagaaagttcagattcgtggttaggtatctatttggctctcatgatcttgccgctgtggcatccaagcttagttttctgatgcttctaagtcactagaccacattagtaaattcattacagatgaaagaggctacctggattctatgaaattggatgaatgaataagccattaaaatatatattcatgttgttaaataaattttgatgggatgagtaattctcatggaaagtcaaaaaattataaagcaggttttagaactgtctgtacattcttagttttgagtgtgaatatataaagtctttttaatattaaagactaaataaatgaaacattattattgttattagtgatttcttattgaattcctaaattgcttttaggaatttattataagaaaatagtgtcctttgcatttttataagaaataaatgcattgcatttattataagaaaacatgacaaacacaatttggaagcaaaaataaggaacttcatttgtttagaatacttatagtaaatatcacaaagattctaaatagaataataaccttatcacaatataacgtaagaaacactgtaatgtgaaatctgttttgttaaaacacatttagatttaaaatttcttaagccattggatatgccttgttatcagtgtcacacactgaaaacttctagaagttgtcatttcatctgatacatgaagagcaacagttattccttaacacctccttcaacaccgcatgattctcctcaattcatattttgaaatttgacatatggcactgatggtgatatgacagagagaatctcaatgtgtcaatgacttcatcatattcatttgggcaactgagctagagtcttctgctccatgaagtctgtaatgacattgtgggaaagctgtaggcaggagcttcatattcagatcaaaggcaaatacaaaccagggaagagctatcttccagtcaatatttgttggcatttgctatattataaaacttcaagcactctcccatttttctgctcaatttttcttccattcattgcacggtgagatatgttccaccatgaacaaaggaagttaataagagttttcaaagatacaataaaatagatgaagtttaatatgacatttaaccctattgcttctcaaacaaaatgctttatatacatagcaagctggcttgctatccatcttctgtcactattctctttgtttactattattttgttttaccttttctaaaatgtcaaatatatcagacacacaatagagtatctgatatatttgtagagcttaaaaatcaataatactacaataaaatgaatatttatgtcaccaccacctacaatcagaaataaaatcctgccactatcttataaatcttctgtgtgcactttgatagacttttgcaagttttagggctgtataaaatagatttacacagcacaaattctgcaacttggctatttctctgcattattatgtttttaggttaatccatactgatgtatatacctttagggaaataatgctgtaaagtattccattatataactggatcacactatttacctgttctttattggagagattactgttgcaataatttttatttgtattatgaacaaagaccagatgcatattctggcatatctctcttggtgcacaatttgaggaatattttaggacatacccttaggaacgaacaaaagtgctgtgtcatgggtatagtatatatttatatttacttagttaaaatcaaattattttccaaattggctatgccattttctcagttaccagcaatttcagaattcctctttctccccatcttctataagatttgatatgatattaaacttttgtcattttgattgttgagacttgatattttatgtttttaaatttacatttttttctgactacttggcaacttctcatgtgtttaatgaaaacatgcgccactgcactccagcctgggcgacagagcgagactctgtctcaaaaaaaaaaaaccaaaaaaaccaaaaaaaacccatatatatatatgttttatatatatatttatatatttacattttatatttatattttatatgtatatacttatatattttatacatatataaaatactcacatgttttttaatgtggcttatttaaggaaactttactgatcatagagacataaaaatatttttcttaagtttcctttaacagttttagatttttgtctttcatatatgtcatccatatatgtgaaattatctattgtaattatttattaagtgttgaagaaccattttaattttccacatgagaaataaattatttgaaaaactaaggaaagttaattatatccattttcacctctaaatatcacctatttatacttctattttccatggtatattatggatccatttctgtacctttatatatatatgtatatgtgccttatataaattattatataatatatattattgtatatatttatattatatatttaatatatagtatatattatatataaatatataatacttatataaatatatatacatatgtttgtttcacatatatatacaacattgcttggttcaatttgttaataatttcttaggaaaatttttatccctcctgactttctatggtttttggtgacaacattttcctgtgtctttgaaggctgaagaacattgtaattttgttgcctagatgtttcttggatttcttccataaaactttttgagcctggggtttattgtgtagggaaaacataattgctagtgctagaatttaggttttctatcatgtcagatgtcgctatgtatagttaatgtttttctagaaatgtgtctattttgtacttttttcaatttattaacatatatatttcatatcatctttatctaaaaatctcagtctcttctgcagctataatttcggcaataccagttttaatattatttatttggcttctttctttaatttctatttttcctgttcattttaattataaattaaataatccttggctttgttaagtctgcattattttgatactttatgttttttattatttatttttatcttctttgtccttattctcttttctttacacacacacacacacaatatttcagatagatgcttattttgttgattttcagcctttcttcttttcaaccatgagaagttaaggctataaattgccccctcaatgcttttagaatcacatttcaaaaatgttgaaaatttatattagtggtaatttagctacaattgtcttctaattatgatttcttttttacccataggttatttaaaagatagttttaataaatacaaatgtatttattttacatatttttattactgaattactaatttatgtagatgtcagagaatgtgggtatactaatagattcttttgtaaaatttatcgaaaccttctttaatgcctagtatatggcccatttttaaagtttcatttgttattaaaaataatgtatgttctacaacttaacagtagtagtagtatcaaacctatacctttggtataggtttttatatatgtccactggaaagtttaagtatattttgatatattcagtatcttattgagataggatattgtgtctgctaatctatcaattgttgacaataatgtgtttaaatcttctacagtgatgtttgttaaattatttttgtacgtctgcgattttttaatttatattttaaactatgtagctaggtacatgcatatttagaattgctacatcttcttagtaaattgaacctttataattactgtatagtggccttctttatagctagtgtatttttgccttaatgctttatgatctggtcaggcaccagattttatctcctaactcctatagactctttaaaactcttaaaatcttaaaatataggatccagaccacaagcaatttacagacgctccaaaacaaatgtggattttaaagctttcttacatcaatagactcatgctttcttatcttatctgattgttgaatgattctatttctttttccatgttatcaccacattttaaaaagagtttgttttgttttgttttgtttttgttatccgtgtttttagggagtagttttctgaaattccagtcagctaaaatcctgaaataggaaaccaactgttattcttacaacttccactatgcaacctctctctcgctagaaaaatagtatttgcaaatatcaaaatataatcccctttcctgttaggtgagctgcatgcaattaaactaaacataatttatattttaaaaattattttttgccattattttcttgagccagtgagttctcttatttttgcccctgtgccttagtgtatgtgtctgtgtgtgtgtgtgtgtgtgtcacatgtgcgtgcacacacatatacaatgtttgttgtatttttttctggttaactgagactaaacttgaaatttaaagctggccttccatgaaaattatttaatgatgcaatgcaaagacaaattgctttctacatcaattttctatgcaagtacctataaatgttagataactaaattatcccagagttttcttcaggaaatatcagccttttattcaagtatatgattttctataaagtattgctattataatcttttaatgctaggtgaatccacatcaagcattcaatatttgttggatgatacaattaaatttctctctgcttaggttgagtttacattgtctttaaaaatgtcttttaggcagggtgtagtggctcacacctgtaatcccaaaacttgatgaggctgaggtgggaggatcacttgaggccaggagttcatgaccaacctggcaaacatggcaaaaccccacctctactaaaaatacaaacattagccaggcatagtggcacacatctgtaatctcaggactagagtggacgaggcaggagaatctcctgtacctgggaggcagaggttgcagtgagctgagatcacaacactgcactacagcctgggctacaggctgagactctgtctcaaaaaaaaaaaaaaaaaaaaaaaattaatatcacaaacatggtaaacataaaaattatcacagtgtaaaggaaaaagtaatatatactcacaaatataaacagacagtgggagtggggacaaatttgcattcatattgaatcaagacatttatatcgcctctatacaaaaacaagatgaactaaactaaattaaagggatgttaatctagaaattaaatgtatcatgtcagctagttttaatatatggatgctttgggcattgtaagattaaactttctgaatcataacagaatgaagctcattaaaataaaataaacttacccaaatggaagatgacctaaaagaataatttttgggcaaaatattataaaaatagctacacagatattagaaaatataacaagcaaaatttgatttttactttggtgtacaatgtcccaacattctgaataatacatacccttttctcttgaaaaatatgtatatactgaatgactttaaaacaaatctagaaattaaatgtatcatattttccatactgtttttgtttcaatcagattttttaaaagaactttcatctctaaatttaggaatctctttttacaattttttcatttacagctacctcaaaaaatagtatgtattcctaaaataatatagtataaatttattttgaacatcaaaaagaatctgagctcacctatagcccacaaatggaaatgagaaactcatgtgttttcatatttataaacacatattacatcttatacaacacattatgaaaaagaaaataaataaaagcatgctaatataatttgaatgaacaagaaatgctggaaatatttgaattctacctttcaaccacattaattagagcttccactaaatcatttccagactcatataactgtaataatttcacacctataattatctctccatgttccctgctatgtttattttacttaaattagacatatttcagtatgttctgaagattttgccttatattcaacattacatatttgtttaaactcctcccttcatgaatgtactctcctctgattctataggaccacccctcatctatttttatgcactagctccattatgaaacctttcaaaatcataaaaagtagaaaattttattcatagttcacagttgaagaaaaggcagctcataaccttgaagcctatatcctactgtgatactctttgtaaatgatagtatgagaattaagcctttatttaaaactttttcatgtcaatgtcagttctgtctccaaaacttaaatggcattattaatgaatgtgttacaggcattacaatgcagtgattaagaatacagccgctaataccagcttccttgagtttgaaacctagctcatggctccctcctcctttgttttgggaaaattacttacactttatgtctcagcttccttattggtaaaaaatgtataatatgcaagtctaccttatagaattggtggaagcattaaataatgcagttgtgaaacatacaaaagagtatctagtggatggtaagtgtaaaagtagtattaactattagtatctactatatggggttgtgggttgaagtccactaataatttgtgtcaacattactctggtaagagttcatggcaatgacttgttgattctaggaaatttctgttcatcaatgtattgtaaaaaataaagaacttcactgttttttatttttccatgaaatgcctacagatcaatttactgaagacaatagtctgcttatttgtgcaaacagttcacttatgaaacaagtttatttcttcactatacctaccaattctaaattattatgtcatggattttttccattcctaatcagttccttctcttgaaagatctgcattacacaacttgagaccagactccaaagctccataaatatcccattctgacctcttttaaacacttctaagattctgtcagggtggtgtgctttttgattacaatgtattccaataaattcaggtgtactttacttacagattatctggtgatatattgaggagagcaatgaactgtaagcaccactgtgttctagctgagatcccctctctgatgtgtcttaagatccttgacttgcaaaatgaatgctctactggggaagccttgagagactctgcaactgtgatggtggggtctaggtattgatattgtgtctcaactttggtcactgtcaagttcccaaatgttagttttattttgtctaatgggaaatagaatctattttaggactttttctgtgatctgtttagattggaaaatgttaatgtttgatttaaatctgctttattgctaaattactcaattgtgtccttctgtcctcatttttgtgagtctctaagaggaggtttatacaaaaatggccagacatggatcctgataagttgattcctagagccagctctggaattaataacttcagaaggttcctcctcggactggtatccctcacataaattttccctggagtcaactcttcaaaaccttaggcaaatgtttcttattcttatcctgttcagtctttgagagtcaggttctgtataaaatctcccattaaaaaagtttatgttatccaagaacctcagattatcgaggctgggattaaaaaaaaaatcattaacttggaggcctgaaaacactatgcaaaagcaacactttctactgcttgttgctagattctcatggctttgaatcacactaagtgtatgccttctgtaggctgaacccttgcctcatatatgtatctacattataaatctaatttccatgactgtctttcaaaaaggcataatttctttacaaataatttacagttaagaggctacttggtgaaatttttatattaacagaagttgttaatttgagaggagtcttaaaatggaaaggaggtaaaattcctattacaatgtgaacttaatggccttttccctactttttattttcccctgtctttgtttactcaatacccttttgccttactccattttctcacctggccccttacctcctggattacacaacctgagtttcacaaatctcaattgcctcttaaagttaagtcctctttagacatcaacaagcttcttatagtttatttttagccttcattctcagtctgaactaagaatcaatgtaaaagtctggacaaagtacagaggaatttagaatcattctaacaacatatatcgtaggtttcccagatctacgtaagtgattcttatgttagtaagaaaattaatgtaaaaaaattggattaaaaaatgaagacttaggataatctaaggtgaatgaaagaccctgaatattagagaaaaccagaagtatttaggaaagctatacacagtggagaaaatattttggaggctaccccaagactttcctgaaaataggttggacttccatctcattataaaaagagaaagaatgaatcaatttgaaactttaggaacaggacctccaacacctttagaaaatattcaggagtagatcttgagacagacaggacctaaaccctctcatcatttttgcaaagagccctaaaccaaaattagggaatgtaaaatggaaaaagtacatcggaaaatgacttcattgacaaacagaactccaattcctaactgaacattttgaaaaagtcatggaataaaaacagaataagcctctgaataagttaacagccttacagatgaaacaactggctatttctcctcaatttatcaagtatcagaggaggaagcttcctgaatacaaacattgatagataactgtaagcagaaaggacattggaaaaagattcataaaggacattggaaaatagctattctgcactaactgtgaaactaaaagaaaatttttaaaaaggaaggatgtgataagggaagttgatgctgatctgtggggtcattaattccctgatgtcccatttctctaaacattaacagacagtatcaaggtttctgattgattcaggcacagtaatatagtttacagaccctgccacacatgcattcagtcactcccctagagtcaataaagtatttaggagatgagtatttgcaaaaatctacagattattgtgtatcactctatagcttttgccctcagatctttaacatcgtttgctcatttgagacagcacttcccctcatttaataggtagggatttcctatgtaaacagaattgctaatttaagtgctctcttgatgggctttctcttgagatctctaaagaatcacctattcagcagggcacggtggctcacgcctgtaatcccaacactgtgggaggccgaggcgggcagatcacgagctcaggagtttgagaccagcctgaccaacacggtgaaaccccctctctactaaaaatacaaaaaaaaaaaattggccgggtgtggtggcaggcacctgtaatcccagctactcaggaggctgaggcaggagaatagcttgaacccaggaggcagaggttgcattgaactgagatcatgccactgcactccagcctgggtgacagagcgagactctgtctcaaaaaaaaaaaaaaaaaagaaaagaaaagaaaaaagaaaaaggaaaaaaaagaatcacccattcataatcatatcacacctaatttggactatggagtacaaggagcctggtatcgacatcaaactcaaattgaagatctactgatattggctgaattattggggaagaacacctcacatttctcactgacccatttaagcctccatctacacttgccctctacaaccaaagggaaaggacaaaagccagcagttgtgtctaacagaaaaataattacgaatactatgcactagtccttggaacactcctattcttctgatcaagagatcccagtgggctggggtacccatttatttcagaccttgcaactataaataaaatatttagccctgttttcctgtggtgccaaaattctatattattttaatttccatgctacctgagattatgtattttagcattctaaatccatgttctgctgtttgtattgtcccttttagatcataatagaaaatactcattagtctttctctagaaaaatcaatgatgtacctggacagttttactgcagaagtgtactgaggcacccaggtaccttatacaagtcttctgctagacactgaaggaccttgaatctctctataattctactcttatccaacatgcagacaatttttgctatgttgtcaagatgagataatttttcaggttgattccaactactacttatagctcagaaagtatataatgtgttcaaagaaaaattagaattttgtaagaagaaaatgcactatttagaacatgatttataatccatcactctggagagattacaaaacactttttttttttctaaaactgttaagaaaatatacttattttaagagactttttttttttcggctgtagggggtgaattttttttttttttcagtgagagcaggttaattaggaaagtaaaggaataaagaatggccactccatagagatttcataggttattacatgcaatgggttcccaatattactgaaattactgtacctctaaattttaacttagttgttagtaactcaatctctttgttgtattataagcataattagctgtaggggtgtgtctctgtgtgccctgggagtggcagggttggggttgggggtgggaggagtaggaggctgtgtgatttaaaattaattatttggccttcctaattatcttagatctttttaccaatttgtgcatgatcaatttggacaagccattggtgttttgactttactttatcagaatctttaaagactattcatctttaaagttatccataaatttttcatagactcagtggcaaaaggctactcaccttgtctaagggcaacagccagactagtgggtaattacagtgggtaatcttctgatgtttctgcattatattctctactcttcacctaattacctctgaatgtcaccaaaactgtacagtaaattttaatcacacaaggaaggtattttggacaatgataagtctttgggtagattctaaagaccagtgttaggtttgcaaaacaaaagtctattgggtgtggccaacaaattataccaaaaaattgttatctttgtaaatttagacactatactttcagaatggtgcctaatattactcatggatgatttgggcacatttccccctcaaaccctagaaaaagagaactctagataatttcattcaagaaagagaaaaacagggcctcattttgagatatacaacattactcatgtctaattctgaatagttttctcctgtctttaaatcatactatctgtgcttcagatattatcaggaacactgaacaatttcagtgaggccatagaaatcatcacctggagatttcataatactgaggaggtggtacttcttcaaaacatagcagtacgagaaataatattggcctgtcaggatgaaacatgaggcattttacaggaggaaagtttactcatattcctatagttctttctgtttttattttattaagaaaatatgggaaattttttaaaaattacaagacaaggtgataaatctagtattcccacatctgaccattaaaactttttggtttggtcatgggttccattgtattgctttaatttaggcatttttggctcttggcttagaatgtaaaatacttctgttagtatctgtctgtgattcagcattcaaatatcaggttttcataatcaaaaatatttctatgtagccactctgatatgacaataaatgatcatgcagccaaaacaaaaacaaacaaacaaacaaacataaaaacctaatgtatatgatagttgaaatgatcccaccagaaatctgatatgcaatcaggaccctgaagacagtggtattgattttgattgattatttgtgcagatgattattatttatcctccagcttaggttgaaaaatgactacaagagagttctgagaaataagaaaccacctatgttaacaaaactttttattgtttgcttcaaaaatattttctatgaaaggataaaatcataagccaactaattttattattttcttcaggaaatttccacagatcaatttattagagacaacactctgctcatctgaataaataatttatcaaacaacagtttacttattgaggctgcttgtttccacatgcatctcgctctgcccaccagtcttaaattactatatcataaactctgtataatctcagttaattccataccttaaatgactcagtttaaatcactttaccacaatccccacacacgttaagtacctcagttttgacttccctcttctgaaacattgctatatcattgtcaaggtgatgtttactcttacctattgtagtaacttctataacatttaaattttattactacattatcattcttggactaaacagttaaattgtagttattgttctttcttctattactattaatactactattttggtatttctccatcatttactgttgtgggaaaatgtgagaaatatgactgtatatattttattttattcacccaaactagaatatttgtctcttttatacctctccaaagaccccacttctatttttaaaaattagttgatatactattttgtatacatgtttgtttctatctgcttatttagtttacatgtttccttttattctttaccatctaagtactcaattcaaataagatacagagataaggtcagtttctgatagccaaagaatagcaataggtttggcacaagaattgcgcaggttcctcatgaatttgactctaagaaattgtgaaatctcggggaagacacacgaaggcctctgcatcccagttttcccttatctcacttttctcttctcttttcttttatcatatgtatgctatgtgagaattacaataattaaaatatgtaacatatgagaattaaaatatataataaggatagagcttactacaacacctagcacatcctaagtgctcaataataatccttattactttgtaatgctcctgtgagtctgaaaaataatgtatttaaggctcctagtagatactcttttaacaggaactactaatcttgttattgatattaatatagcttggctatattaatccaggtggatcaacatcctctgtataaatgaaaccacctatttacaaggtattccacaataattcaatgttgcatcttcagcaagaacaagccataggtctgaaaatgtaagtgcaaggcattgagtatgcatttgtgtatgtggtctgattattgctctgaagataaacaactactgagaccatatattctgaatcctcttacaggaatacagtatatgattgaattttttttctatctacagcttgcaatgactaaaaaaatgttggtttgttcccacaataaattccctccaagaccacaaatgagaaataccactttacatgtgcataccttaatgatgacctcttcttgaaaacaaaacaagcatgctttagacagaattagcttctcactgtagagatgactggcttaaatgagaattctgtctttgctctaataagtttatttgacatcttggtttgtcttatagtaaaaaaaaaaaaaaaaaaaaaaaagaaaagaaaaggtggtttgctccctttccccatggtgttaaattaattccatgagcagttttgttactctacacaataatacagtgtgtccccttatttatgtcataatgtgtcataatgtctattgggaaaagagatcaatttatgtaactcaatttgttgtctttaaaggagtttaacattgtatttgagctggacattggttgccttgagctttgagaatttaggctgattcatcatgtgaacctgttgtagaaatgaccttctctaggcttctgctttagtttttacatgaatggtcctaatgtccgcctatagaagattttgtgcacatgatgaccttagggttaatctacatcgggaaacacttaaattaccataataatgttctctcgaaattcttaagtatgattaatgttggttatgtatcggcctagatagagatttctaaaagtgagtgttcctgagtgctttggatgatactttgtaagcatatagacatgaaactatttaaaatcattgcataatgttgcaatatatcaaattattttcctcttgacgtatatttagattgttttttgtcactcattaaaagaatgctacaaggagttttttttatgtacaacactttgtgaccatataaaggcagttgcctagatttggaatttgtatataaaaaatatagatacacacttttgttaaaagcttaaaatttgccctttcaaaagaatgtacatatttaatttttcaataatcatgtataaaggtgtcagctgtattttcataagtttaaatgaaaataactgcttgcgttatagatttttcttttttatgttataaaataaaacttgctctaatttatgggtagaaagaatatgccttacaaatttaattaaaagttttaaatgttaggatataatgaaaatcaccccattcttttttatttccgaaacaagaaagggatgttaagtttttcaaaattgattcacatgagctaacattaaaaccattggatgggttgtgtttgtgtccttgccagttagtaactttattataaaatctctaaatctattaccttctgtaaaatgattttgaataagcatctgtgtaaaaattgttttctttttcactggattagaaactctgttaatgtgaacacagtaaatgaacttaaagaaatagtcaagagtaagaaaatatgagaaaataacttttaaaaataagttggcaagtcaagttctatggaaaaattaaaagacgcttaaacatcttaagtaaaatttcaacatgcctgttacgacacatccccaggaagtttattttcataatatttgatgtgattttaaggtcatcatttaagagaaaataaaaaaggtcatgaaagggattttccacatgagggcttccaattgaaaatatttacatataaaatgttaattgtagaaatacaatccaataatgaacaaagttcaaaagtgagtaaaccctgaagcaagacaaggcaagatatgtaatatctatcaataaaactaaaacattttcaaacatttggtgggaaagactatcttagttaatcagggacttctggcttaaggaaagaaagcaacttgtcagatttaatcaaattcatgggaatcaatagaattgttttcttttgttggttttcccagatatatgtaccaatcagcagtggtgataacttagatgaaaggaattggtggaaggagaaaggtctcttcaaaataggatattatctcacttcctaggtttcataatctctaataaagcactcctaatttaaattgaaaaacatcactgtttatttcatgcaataaattaaatcaaaatatataactggtttgatatttgtttccaagtatttgtcagtctttagtcaacaattcattaaaatgaaaaaaaccttaattctgatttacaaaatgaaaactatcaatggtaattattattattattattatttctatttttagtagcgacagggtttcaccatgtcagccaggatggtttcgatctcctgacctcattatctgcccaccttggcctcccaaagtgctgggattacaggcatgagccaccgcacccagctttttttttttttttttttttttttcctgagattgtatctccctctattgcccaggctggaatgcagtggtgtgatcttggttcactgcaacctctgcctcccaagttcaagggattctcctgcctcaacctcccaagtagctgtgaatacaggcgcctaccaccacacccagctaatttttgtgtttttagtagaaatgaggtttcaccatgtttgccaggctggtctcaaactcttgacctcaagtgattcacctgccttggactcccaaagtgctgggattacaggcatgagccactgtgcctggcctatcaatggtaataccttattgtagtatgtaaggattgtataattctattggatcttgaaaggttggtaagaaatcactgaaatgagtaagaatggaattcagtaactcaatattgatatcaagaaattagaagagaaaacaatacattgtgcataatgaagccaaagataagttaattattccttttatgaaaggtctctcatggcatacaaagtcatgtgatacacagtagcacacctcatctcttacatatgaaattaactaggaaagtgtgtttttcaaaatgggcatgaagacattagtttcacaacatacttatatataatacctagatatacatacatgtaacatatacaagtatacatagcacatgcttcatatatatgtacatatatgaaatctcactctcagtctctctctcttgatatacagacagaaagacagagaggtagagtttcatgtatagagagctatatattataactctttatatatagcacggaatgattgaaaccaaatcatttcaggtccaaaaacatacaagtaagggccccttttgtcagtttagttaggtcaatattatacccacctctctatttgaacttgtctacatgaactgtctctatgaatttcagtaaagtggtaacatgaactctaatgtttgttggacttaaccttttaggagcaatacggaacactattaaatgtttatttactcatgtataggagataaaagatagtgaattcttagcaggcttcaaactaacttttgagcttgaaggtacttatcaaaacttataaatgataaaggaaataaaaaaagtgctatcaaggtggatttttaaaacaatttacattttgcttatcattttgatcttcctcttatgatctatacatttgaaaaataaatacgtctatattattgcccaggttttgaaataagcccagttactaataatgccacaagctaagactgagtctactgttaccataaagccagattagcaatccaagggcctggggaacttccgcttttttagcgcttttcctctggtgggtttgttcttgcatttgaacaaagctatgggtttacatgagtaattgcctaagtatctggacttgccgggtatcactgacaacaggcccaaattataattaactcaaagtaccgtgttaactttttcagccaaaaatacatagaccataagatattaggctttctggaagagtctaagttattggctctggcagcaaaagagtaacatattaactgaagagtaaagacaaagcttcagacaaaggttctctataaataattgtgtcaagatgtcattacatcagtggaatgtagctcaattaacaatatcttttaaaggacatcaccttgccctaccaagagaaggtagctgttaaattgtggctccagcttgaggtttgataatgtggcagctataggatccatttcctgttctagttgtgtatattgtggtaataagaaaagcaacagagccccaccataaccaaatacttttaaaaatacaaccttaccctaagaaattaagtaaaaacaaatcttattcctctggtcagtgttgaagaaaaaaacaaacattcgacttcgactggttgcctcacagggggagaaaaataatagtgcataaaagcaaagcaaaacaaacaaaaaaccttagtgagcctagctgacttgttctcaagaacacagaggaacatggaggagaggcaaggctgttgcctagttctaaattaattaattataaagaattacccccaattaaacactaactcactgcactttttttgtagattccttgtttttcccccccacatcatactgaatccaccaaaattatcatcaaaattttaaagcttgataaattattttgtctatccacttcaaatgattatacatcagacaagatccctaacgacatatcagaatgaattacatatctggatatgaaagaactaggatgtctaatttaaggcaaaggtggagtttgcaatattttagtgagaggattgagaagtatggctaaataggaattaaagtcagcataatccttacattaacggaattttattaaaattgtaccatgttatgagtagcagaaagtatttggaaagctgtttccatgtttacctttagtgtagtagataaaggctatctcaaataaaatgttcagtctaaaatgacggcacattttttcttacaatgattaattttagaaaaatctataatccaatttactgcttgaatttacatggttgcatataaatgatgtgactcctggtgtgaattaggtggcaaattagaaaagggctttttatttttattgttttttagtgagaaagcaggtatcaatataactcagagaaatattccctacatcttagagtgagattaataaatatgtctttgttatcaataaaatgggaatataattctatctctttgtattgttataaagattaagttgaaaaaattatgggaagtccatagtataaaactgagtaccctcaaaaaattactctacaaattattgtttatttctatattattttatcatgtatcaatacatattacattttcaaaaatataaaaatacctcattcttggaaaaaaatgaacatttaagagagacaatatgtcactttctcttcagcaatgtcaagagaaaggaaattttaaacagaaaactgcagatgtctattcctgtaacacaagtggatgcattgatctagcaaaatgagatgaacccaaaccattataagcaataaactcacttcattcacttggattctaatcacatctttagaattgaaatttggcttccaacttccatgttcctacaaggagaaaatgtaccacctaatattcaaacattccaacacctttcctttgtcaattatatttcttttattataaatcaacaaatttgcatgttgtcacatagttgtcttgcatgggtttggttactgtgatcccttctcctgactccaatcacatccagctatggagacaaatataaatttcttgatctgtgaatcaacctctggtccttgatttccccagacaagtatttctacccactgaggcctgaccttaacagccagccagtctctttagacagcaattatagccagtctgtttctaactattgcactgtatttataggttgaaactttttaagtagaaactagatatcaacagggctgcctagggtatttctgaatgatgaagacaatgaggatgatgatgatgtcaacaatgggagagaaaattgtctggaaagagcatgctgttactttctggaattatgaaaatattttattccttgtttggggtggtatttacctagctgtttgcaattgtgaaaactcatgaaattaaaaacttaatttctcgtgttttcttttatgcagattatatctcaatatgttcaggcagtagaaataactatgagatttcttcttcttaaataaaatggaaggccaggcgcggtggctcatgcctgtaatcccagcactttgggaggccaaggcaggtggatcacttgaggttgggagtttgagaccagcctgaccaacctggagaaaccccatctctactaaaagtacaaaattagccaggtgtggtgatgcatgcctgtaatcccagctacttgggaggctgaggcagtagaatcgtttgaaactgggaagcggagtttgcagcgagctgagatcgtgccatttcactccagcctgggcaacaagagtgaaatttcatctcaataaataaatacatacatacatacataaaatggattgtgaagatttgaatatggactattcaatttgtggtataattttttgtcatatttgaagaattttcttcacagagaagctttaggtttacaaaaaaaatgggaggaaggtatagatattttccatatactcctgtccccacccatgcataacttgtattatcagcatcccccaccaacgtggtacacttgttacagttgatgaaacttcatttacacatcattatcactcaaatactagtttatattagggtttattctttgtgttttacactctgtggctttgactaaatgtataatgagatgtttctatcattatagtatcatacagacttattttcactgaccaaaaaatcctctgttctctgccgattcatttttccctgaccacaaccccctgacaatcactggtgttttcactttctctatagttctgcctttcacagaatgtcaaataggtgaaatcatagcgtatacagccttgtcatattgcctttttccatttggtattttgaatttacagtttgttcatgtcttttcaaggcttgatagtacacttacttttagcactgaataatagtccattgtctgaaggtaccacagtttatttatccattcacttactgtagaccctcttggttgttccctcccaagttttgaaaattgtgaataaagatgctgtaaacatctatgtgcagatggatgttttcagcttctttgggtaaataccaaggagaatgaccgctggattttatagtaaaagcatctttagttttgtaagaaactttcagattgtcttccaaaggcactgtgtcattttgcagtccccagcaatggatgggacttcttcttgctccacatgttcaacagcatttggtgtcatcagggtttagaattttggtcattctaataggtgtgtagtgttatctcattattatttaaatttatatccccttgataacatctgatgtgggacatcttttcatgtgcttatttgctctctgtatatcttctttggttaggtgactgttacggtttttggcccatttttaaaatgagtggtttgttttcttattgttaacttttaacagatctttgtatattttgcatagcagtccttaatcagatgtgtcttttgtgagtattttctcccagtttgtagcttgtcttctcattcatttgacactgtctttctcagggaagaagtttttaatttcaatgaaggtcagattatcaatctttaaatgaatcctacttttgatgttgtatccaaaaagtcattgccatactcaaggtcacctaagtataattgtttttaatagaaatcatatttttgaaaaagaaatatagttaaattatatcatttcacattttttatcaatgcttttagctcttccaaaccattatgaaatagttgtatttttattgtgttataaaatcaaatcataattaagcttttcaaatgcaaagctaaaaaatgaaatagcataaccttttgaatcgaattgaatagttcaagatctctatgctctatgttcaagcattatgttaaaactgctgtcttactatctacagaattttctaattagcctaaagagatttttataatttacctataaatatattttgagagggagtgataataaaatcaaaataggtcaagatatccaagtaactttattgagatgtcaagtggcatccagcagaaggtgaagaagtcacagagttacatcatagaaggccttcctgctgtgctatttccttcaacagaaaaagaagctttcatcctctaaggcttccagcatctgctgaaactactttgagtaattcaatcttgtaaaaattatttctgctacgtatacttatctaacacataagtatacttataaaaaaataaaaccttgggcccacttgagaaactaaattatatttagtaaggagatcaattttgcacaccttggcttattgtgctctatttaaaaacatattttcaaaacgtagctcttttttttccctgtcatacacttggcttcagtcattttgctgtaattaaacatgataagtacttccccatgttagtaaggcctgtgaatttccttctgcttgaaatggctcatcttccagatgcctacatggcacaaggcctcctttagttcctgtctctactcatgcactgcatcactttctccaagaaatctacttcaccactgtctaaaatagcccaccacgcattccctcacatcttatcccctccctttttgtacataatacatatcactacctgatatattacatcttcatttgtttattcaaaaaatggactttgtagacttttaaaaaactgtaaaatatagtcttcaacaaatagtatgctttgtttctattttattgtggtataatttacattcagtgaattgcactgatcttaaatattactgttcaacagttttgatgaatggctacaccagtgaaacctgctatactgagaggacaaagagcacatatacttctcttccccaaccactatctaccccaccctttccataaaggaatacaggtagcctgatttatttcactattgtttacctgttacagaacttcatataaatgaaataatacagtatatcaagtttatgctacatgtatattatctaatggtacctttttctattttaaatatatagaatagcaaatatgagaatatttttaaactcatcatcatcattctaaattgtaaactcaatcatcaataaaaattaagatcttagtaaacctcacaaaccattttgtaaaaaatttttgattgccattttgtagtctgtaatatatgatttatttttgaaatgtgggaaacagattcaaaacctagtttcaaggaataatctataaaaattgctctaatataattttaaattatttattttggaacaatcataatgttttcagagaccatagaattttagcacaatatcctgatatttaaaaaataaaagaaaaaaagcaaaacccaagaaattaaaaaactacatatgctaatacagagtcaatatatacttggatagtttgttattactattgaactttttataaaattaaagtatatatatgaaaacagagaatttactaaaaactatactgtgaagaaaatatgtaaagcaatattcttgcacaataggccattcaattatcggtgggttttaatctcattttttatttgatcatgcttattgcttaatggtcatagaaatgttcctttatcaattttcatgggaaagttttgcagcagagaagttccctagaatcaacatgtcttagatgtttgtaaaataagtgatttctttttccaaaatgttaaaatcattagtacacaaaagtcattactacgttaatttattttaaagtgttccatttcagtaagcaggtattaaggaagttggtgttgggataagataattgtgccaaagtaaattcttaatggagttcataagagaggaaatacagtaactgttctactccaaggttggctttgggggatttttcaaaccaacttaaaagtcttggatgttatatctgactggaaattatttctactccctgagaatgaacaacatgctggcaacagtgaaataaggaagcttgaaaaagggaatgagttattctatgaaacagtctgtcctatacatcaagattcttttagtttctcactcaagactttaagatacacaaaaatcttgccgcaagatttctcgtaggtggtgtgacctcagtatacgttgaagtcagagattacattgggttctaacaactcagggtttttagataagatctaaagttaaaagctataaatcagacctctagaggagggctacattggtccaaattttcatgaggaatagactctctttgccaatacaattaggggtgtgtgtgtgtgtgtgtctgtgtgtgtgtgtgtttgtgtgaatgcgtttatctcactgtctcgggagtatgtaattgtgtgataggtggaaattcataaggagaatggatcaactacaagtggtcatgggtagtgccatgtggaaccatactggagcctaaggcaaaaggaaagtgtctggctatatacgtgacttcctgtgctttttaatggttatttttctcagaacacaaaaatagttttaaaaaataatgaaaacctggaaagtagagtattgaaacatacaatctagtttttaggtttaaatatctcatttatacctaaacctgaatatattataatattttcaaaatgtactcttttgcttactcatttttaattgagagaattgctatgtttgacaatttctcttgacaaatgtcttgattaacttttacttaatttcaacttactgatcctttcttttagattttgataaactatttcttgtgggattttcacattggatttctattttttaaatattgcattggaatatatttattctattattaagttgtgttggcattccttaaattctgcacccgaagaaagtgcttcacttgtgtccattttttttcctttcttttttgagatggagtctctctctgttgccaggctggagtgcagtggcgtgatctcctctcactgcaacctcggcctccaggattcaagcaattctcctgcctcagcctcctgagtagctgggatgcaggcatgtgccaccacgcctggctatttttttttttcttttttttttgtatttttagtagagacggagtttcaccctgttgctcaggctggtcttgagctcctggcctcacgattcacctgcctccgcctcccaaagtgctgggattacaggtgtgagccactgtgcccggcctcacttgcatcattctagttgcagccctgatgatgaattcttaggtttgaccttggattgtgtgtatccaaagtgaggcaaaagccaccagaaatgagatcaaagaactgagagcccaatgccctaaaacagactttccatgtagacagcaaatgcacaacgattataagaggaactgatgtagagtggagggcctcgagccagaaatttgaacgaggagaaactactggcaagacaggagatgcaagcaacaacaaagttttggggtacctggggcttaaaagagcagagatcttggcaaatgagaagataccagtcccaccctcttgctctgaggtgctgaagtacgagacaatagacaaaatttgaaaaaaaaaaaaaaaaaaaaaaaaagctgcaaagaaatggtttcctggaggaaagcatgaatgtcttaaatataatgggctttctgttcagtatttcagtatctggtaaatctcatcattagaagcaatgcagaaaattaatatattaccttcacaataccctcattagaacacaattataacaaccgaaaaggcaatgtactaacccatgaggactcacttaactcattacaatggtttagtgagctatattgagcttaaaacatatgctggaatggaaataaaaaaatgaaaaccctgaaaaataagctcttcagaggtttagaaatgaaatgggagtgatgaatagctaggagcaaggacatgggagtatacatggtgccaagagagaaggtatcattttactaaacacatacttcacctttttcacatttcatctaattttagcagcttaaaaaaagcttttgtttttagcttagacagaaactcttaggctttggacccatgttccaattctatacatcaaaaattgtgaaaatttctagagggaatgatggcaggacttctcagaaggttggaaaatggagggtgtgagttgaagaacagtggttaatgacaaaaattgtagatgaggtccacctgatcacaaatcatttctaaaaccatatttggggatttggataatttatttgcactcctaaacctctgtttcttcatcaataactgggcataatgatactactcaggtttcttatgagaattagatgacgaaataccgtgtttgtcatgtaggaaggtataataaattttacacctgcctacatgacatatatggtataattaatttataattaataacttgacttttataactaatttactgacaattacttattgagtacctgctatgtgttagggtaaagcaattcaagaacctaactgaactcctgatatttgtggcttttacattctagcaggtgtgccataatgagtgatattatttataacatcaaacgctaggagaatcacaaagagctgactccaccttgagtttgccttctagaaacagaaaaatagcatgaatcctaattttcacaaagtagatgaagatattcaatttgatactttaagaactttccaaatgaactaatttgaaaggaaaacgaaaagagaggattgaaagaattgtcattccctgttcaaatatttaatcttgtcaagttctctttaaatttgagtggaggcaaattcctgaagatcaagcacctggcctatgaaaatgtattaaatatgttttgatgataatttcagtgatcatagaaggcatttccaaatggaatccattacactgcttcaagtattattacaatgagttctagttctttcactaggttaatagattaataagttttattatcttgcttgtagaaagcattgaaaattcccaaggaagaaaaaataagttcaaacaagtaaccagaaaaataaaagagaaaaaggataattcacttctctattgtaatttatgtgtttcttgtatgtgggattagacccagcaaagctaaaagaggcaactaaaagctcagccccagtgctaattttgtatccttgaggaaatcacataccctttcaagttttaattattcatctgcaaatccaagattataaaatgacctcatattctagttgacaatgtttttatatcaatattttatttctttactttttcctcatactgtgccttgcttctcctttatatgtaaagtttacatatcaatttatacatgcgtatatataatttttctatcaatttcaggagtggataaaggatgtctttgacccaaattcttgccaaatctccttccaagagaagtattgcctattatactccaaatgtacaataccatagcattagtttagtaaaaaacaatatgtcttgtttctcctttatttttcttgatgttttcataattttaataaaaaacacttaaccaaagtgctgaggctgtgtttacaataaggtatttttaaattttatctctcctctaccaacacatacacataaatttaggaggaaaataagattaggtagcatcaatttggtgctaatgaaaatgaaaccagcattgatattttctaaatctaataatgcatgcattttgaatagttttctttgactcatttcccctgaaggtgaattcagattctttaggcattttcccaaaaataatttttaactctctgccttgtagtgaaattttccaaattgaaaagccatgtagaatacactgcgaacaattttacagccttcattaatatataagtcaatgtctaggtcacagcttctattaggtagccttatctttatcgatagttttccccaacttcagattctggtaattgcatgacttaccctaccctctctgtgtttaaatcctagattaaaggaggaaaacagcgtcctgtgaacactagcctcaggtgctgacagcatcatcctttgtagcagtccctgcaccttatccttacttagtaaataatcctttatttaaaaaaaatttgtttgagttcattgtagattctggatattagccctttgtcagatgagtaggttgtgaaaattttctcccattgtgtaggttgcctgttcactctgatggtagtttcttttgctttgcagaagctctttagtttaattagatctcatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcccttccccattgcttgtttttctcaggtttgtcaaagatcagatagttgtagatatgtggcgttatttctgagggctctgttctgttccattgatctatatctctgttttggtaccggtaccatgctgttttggttactgtagccttgtattatagtttgaagtcaggtagtgtgatgcctccagctttgttcttttggcttaggacatgaacagacacttctcaaaagaagacatttatgcagccaaaaaacacgtgaaaaaatgctcatcatcactggccatcagagaaatgcaaatcaaaaccacaatgagataccatctcacaccatttagaatggcaatcattaaaaagtcaggaaactacaggtgctggagaggatgtggagaaataggaacacttttacactgttggtgggactgtaaactagttcaaccattgtggaagtcagtgtggcgattcctcaggggtctagaactagaaataccatttgactcagccatcccattactgggtatatacccaaaggactataaatcatgctgctataaagacacatgcacacgtatgtttattgcggcattattcacaatagcaaagacttggaaccaacccaaatgtccaacaatgatagactggattaagaaactgtggcacatatacaccatggaatactatgcagccataaaaaatgatgagttcatgtcctttgtagggacatggatgatattggaaaacatcattctcagtaaactatcgcaagaacaaaaaaccaagcaccacatattctcactcataggtgggaattgaacaatgagatcacatgcacacaggaaagggaatatcacactctggggactgttgtggggtggggggaggggggagggatagcattgggagatatacctaatgctagatgacgagttagtgggtgcagtgcaccagcatggcacgtgtatacatatgtaactaacctgcacaatgtacacatgtaccctaaaacttaaagtataataaaaaaaaaaactgaaattggcctgttttattatttctcgtcagttctttgatttaataaaccagataaaatctcattataactaattcctaatattagccaagttattttattaaaaataactaagacagaaaaaaattggcttcaatatttggttataattttagaatatgagattacaaagaaattgtattgtactcatgatgttggtagcagggtttaacaatatatcttgggaaataaaatatttccatctatatcagaatgatatctagatgcttgtgtttctcttaatcttttaaagcttctttttaaatgtcttgttctactgggcttactctacagtgcaggtagatatattgaaaattcctaatttttcaatatatgaaagaaaaaagcaaagaaaagaaatatcagaacaaaacaggtatttagtaataaacaagtcaactgctttcttaaaactagagttgtaaattagttctcagacacttccacataagagtcacatgacacttactaattttaacagaaggctagccctgaagcagtgacacatgtttttgtgccatatttaattccacacaacattgattttaatgggaattgctagggagtaactacagttttgcccatggtcatcaaagtcactacaacatgtcttcaggaactatatagtcaattcatcgccctggccaatggccaatttgtaagttagatacatatcttttaccttgttattaaacaaacaaacaaacaaacaaacaagctctattcttctaagtgagttggttacatttaaattatcatttatctatgtatgtacgtatgtatccatctatctatctatctacctacctatctatctatatcttttgctgatgtagaactgctgcttttccagttgtatccaagtaaagttccatatcaatgcaatgatcccttttgtacagttattaagtataagttttctataaaaattagcattggatatgtagactactcatgtagttagcgatttaagttaagaccagacttggagaaataaatattaagtcagaatgaaaatcactgatcagctgacatcctcctttaaaagtgagaatatttcccacagaatactaatcatttaaagacaacttgctgtaaatgaaagacaaagatgaataaagccaaacactggtatgctgcagggcaagatctttgtatatattctatccggtatttgtttttgaaaattatctttattcatgtcatgaaattatcaaagaaaagagtgataaaggatctctgggttatgacagcacttctcctgcgatttttttaaatgtaaggaattcagtcagactcagtcagtctaaaaagatgcaaattcttgggaattgtatccagatcagataaaacgttggacactggttaacacagtatggtccacgtcactgactctcacagttacagtgtagtaatacatcagattatttgccaaaaatgtccagtgatgtttgttccattagtactcaaagtaaaagagtgcatctattctctcaagtaatattgaatgtacagtgtgtttcagacatttgtgaaaaaaatacattggtagttccgctcttgaggagtacgcaatctgttaaagaccaccaagttatttttttttactggaagtctttatgcaaagatagagaaaaatgtctacattgatggctgaacacctaggggattgaggtgtagtgaagataaaagaagagcacagaatgtatacctgaaagacctgaagaaaattttaatttcttttttttttttgagacagtctcactctgtccccaggctggagtgcagtgacgcgatctcggctcactgcaacctctgcctactgggttcaagtgattctcctgcctcagccccctgagtagcagggactataggcgtgcaccaccacgcccagctaatttttttttttttttgtaatttttagtagagacggggtttcaccatattggccaggatagtctcgatctcctgaccttacaatacacccgcctcggcctcccaaagtgctgggattacaggcgtgagccaccgctcccggctgaaaattttaatttcttgacccatattcttcagttccctctaaactatgctttcaagaataatgtaaatgcaagttaaaaatgtagtgtccaactgttctcacattaagaaatcagggttacatttggtgagaatacaaaaaaggaaaaaaaaataagtcaagattaattgatcatattaatttcatggtatcactccacgaaaatccagaataattaaattaaaaacaaaagttcaaggcaaagcattgctacaaaaatttcttataataattaatttactggttatgccccttacaggagtcaggaaacaggttagattccttacccagtgtgcccactaatagtccctttataaaaccatctcctggaggcactagtcctccctcagaagaacagtaggtgaaggagttctctggtttctggccttgaggccagttcctgtttaagcctaaataaatgaataaataaataaataaataaataaataaataaataaataaatattcctcttccaagaggcatctggcagttccccttatccctgatgagtccttcttaagaccatgtcgaattaagttaaatgaatcgaaagtaaattaggattaaattgtataacattgattcatacattgccttggatgatttatatacatttggaaagtttaatactttatcacaatggttaagttttaatgcaaaataaaattatctatgtagtgttttaaaatgttgattagcctactccttagcctttttgaagtactttttaaatttctggtgtaaattctggcatgtagttctttaaaaaaatcctgcaggaagtttttgtgcctttcaaagtttgagggcccctaatcttgggcatacaaatcagtctttcttctgattaatgtggcattgtccatcatttttataaatatgagtctcaaacccttgattgataaagaaaatgctcattataacattgtgacatttggaaaaatttaatattttgtatttttaatataaattaattctttcagaactattaaccttataggaaaacactagagagaatgattttagcagatttttgtaagaactcatctcctaaggtttaagaaatacctacatggtttaaaatagtaattataaacatagtaattttaaaataagatactattttgtttaggtcttccaagtcagttagctggtgtcagttttatggtcagaatgacaaaaatatataataaaaatgtgcagctcatttagctgttgaaggctaatgaacaattaaagcattccataagaacttaatctcacccattttttagtcctatttaaatctgctcctcctttccacaaagttcgaatggcataaattatttaagtcatatacaaagggaacccaatcaggctggcagaagacttctcagtagaaatcttgcaagccagaagggattaggggcttattttcaacactctaaaagaacttaaactaataatttcatattcctccaaacttagctttgtaaggaagggataaataaagtattttctagacaagcaactgacaagggaatttgtaatcactagaccagctttacaaggcaacctcagcggagtcctaaacatggaaaaaaaggacaatttctgccaccacgagaacacaattaaatacatagtctgcagaccctataaagcaaccatataatagaaactacaaagcaaccagctagcaatttcacaatgggatcaaaacctcacatataaatattaaccttgaatttacatggtccaaacaccccacttagaaggcacagacttgcaagttgtataaaacacaaagactcatccatctgctgtcttcaagagacagaactcccatgtaacaacacccatagttcaaggtaaagggttggagaaagatgtatcatgcaaatgaaaaacaaaaaagaacaacagtcacttgtgttagataagacagaatttaaaccaataataataaaaaaggataaagaatgtcattaaataatgacaaagggttcaactcaacaagtagacttaactatcttaaatatgcacacactcaatattggagcacccaattcataaaacaaatacttcaaaacctataaaaagacttaggcacaaaacaataatgggagacctcaacacatcaatgacagcattagagagatcatcaatgcaaaataacaaaataatcctggacttaaatttgacacttcaccagttggacctagtagacgttacagagcactctacccatcaaccacagaatatacattcctctcatctgcacacagaacatactctaagggtgaccacatgctcagccataaagcaagtctcaataaacacaaaaaattaaaatcatatcaaccatactcttgaaccacagtagattaaaaccagaaaccaatactaagaacatctcccaaaaccacacaatgacatgcaaattaaacaacttgctcctgaaggactttcagataaacaacgatattaaggaaatttataaaattatttaaaatgaagacacacaacatttcaaaatctctgagatgcagcctatacaatgttaagaggaacatttacagcactaagtgtctacatcaagaagttagaaagatctcaaattaatgatctaacattacacctatgggaaccggaggaaaaggaacaatctaaacctaaagctaatgagaggaaagaaataactaaaatcagagcagaactgaatgaagtagagacccaataatccatacaaaagatcaacaagaccaaaagttgggactttgaaagcataaacaagagagataaacctccagctagatgaacaaaacaaaaaagagaagatccaaataagcccattcagaaacaaggatgacattacagccaaacacatggaaaccgaaaagatcctgagaatattatgaacactggatgcacacgaactaaaaaatctagaggaaattgatacattcatgaaaacatacaacctccccaaattgaatcacaaagaaattgcaactctgaacaaatgaatcagtcataaaaaaccctatgaatcaactaatgtccctgaccaggtggacataattcacagccaaattatagcagaaatacaaagaagtcctactaccaattctactgacactattacaaaaaattaaggaggaactcctctgtaactcattctatgaagccagcatcaccctgataccaaaacctggcagataaacaatgaaaaaaagaaaaactacaggctaatatccatgatgaacataaacacaaaaatctccaaccaaacactagcaaacctgatccaacagcacatcaaatagctataccatgatcaagtagcctttatttctgggatgcaagagtagttcaacatgtgcaaatcaataatgtgattcaccacataaacaaaattaaaaacaaaaaccatgtaattatgatcatctccatagatgcagagaaagcttttgataaaatctaacatctcttcatgataaaaatacttaaaaaatgagtcaccaaaggaacatacctaaaaataataagagtcatctatgacaaacctatagccaacatcatactgaatgggcaaaagcgggatcaatcccttgagaactggaacaaagcaaggatgctcactttcactacttctattcaatgcagtactggaaatcttagagcaatcaaagaagagaaagtaataaaagacatccagatatgaaaagcagtcaaactatttctctttgctgactatatgtttctacactaaggaaacctcaaagactctgctgaaaggctcctgaaatggataaatgacttcagtaaagtttcagaataaaaattcaacatacaaaaatcagtagcatttctataatgttcaagtggagagtcaaatcaagaacacaatcacatttacaatacccacaataaaaattaaatgtctatgaatacatccaacaaagaggtgaaagatctctgtaataactacacaatattgctgaaagaaataatagatgacacacacaattataaattcattccacactcatggaaggtaagaatgagtattactcatggtcatactgcccaaagcaatttacagattcaatgctattcctgtaaaactaccaatgccatttttaacagaaatagaaaaataggattctaaaatatagaacaaaaaatagcctgaatagctaaaggaaggtaaacaaaaagaaaaaagccagaggcatcatattatccgacttcagctatacaataagtctacaatatccaaaataggacggtattaatacaaaaacagacacatagacgtatggaacagaaaagagaacccagaaggaaagctgcacacctataatcatacgatctgtgacaaagttgacaaaagtgaacgctgggtaatgttcaatatatggtactcaaaaactggctagccatatgcagaagaatgaaactggactcctacctttcaccatataataaattcactcaattcactcaagatggattaaagatttaaatgtaatacttcaaactataaaaaccctagaaaaaaacccaagcaacatcatttttgacattaggctaggaaaacaatttatggctaaatcctcaaaatcaattgcaacaaaagcaaaaattgacaattgggacctatttaaattaaagagtttgcacagcaatataaaaaaattttaaaaagatcaacagagtaaatagataacctgcagaatgggagaaaatatttgtgaattctgcatctgacagaggtctaatacccagaatctataaaaaacttaaacaaatttacaagaaaaaaataaccctattaaaaagtgggcaaaggacatgaagaggtacttctcaaaagaagacatacaaacagccaacaaacaaatgacaaaatattccataaagattgttaagttccattggatcgcatgataatttcattgaatctgtgactggtaaaatttacagcttcagtaacaccagatgtaaaatgaagaatctatatgttggtcaggttataatcaagacattatttttcttgtcataattacacatactcttttatcatgtattttcttgaggaaatacatatatgcaaacaaaacggtaggtgctcttattttctttttaaacaatacaatatgaaatataaatgtacactagatgccacccaatttaagaaatagaacattactggcaaggtgtggtgtctcactcccgtaatcacaacactttgggaggctaaggctggaggattgcttgaggccaagagttcaactagcatgggcaatgtagggaggccctgtctctacgaagaaaattaaaaaatatagctgggaatggtggtgcacacctctcggcaggaggatcacatgagcccagaagttcaaggttacagtaagctatgattttgccactgcactctaggcaatagagcaagaacctgtttccaaaaaaataaaaataatgaaaatatttgatctaaagaaaggaatataccatgttttcctttatttagcatattaataaaaacaataaagatacacatatttcagttactggtatcttagaatatcttgcatatatacaatctgagctttttgatcaggaaaaaaatttaaaagaatctcttgcataccttttcttacactatcctgaattttgcgttattacttgccatagttgatagacagactataatgtatgcacccctaaacagtatatagtttttccttttttaactttatgaaaataaaattatacccttgaatttatacccaaaaattctcatatgaaatattttatccatgcaattaacaaatttaatccaatggctataaaatatagactattataccaaacaattgaggaattagaatgattctataatgtcttttatttacttgtgctacttggataattgttattttcctccattttattttactaagtggagggctggtttatgttaccttttcatggagaggacaaaattaaaggtatctcaaggcaagactaggtgtgggcctgtagacaacactaaaatgaatataaggagagagatatgctagtaagggataccacaatgggcaaatgcttttatttttgacctatggatgggaagggatacacagacctgtagggttaatggtatccaaacacatagaaattctaacatacaagcattcagtagataagattatcaactcccaatttctactaaaaaaaagttcatatgctaatcaaccatatcagttgcttcaattataaacctcatttacaagtcttaatagaaaaggaattgatttttttctgctttcaaagagaaaatgagtgaaaatagacaccctctaaagcatattcaacacctacccaacaaactttcaaaggtagatctatttagctaccaccatttacttgaagttaaaatggtacacaaaaatctattgcctaaatggtagtcttcattttatcatttaaaattaagattcgactaaaagatcaatagaaaaatatttgatctaaagaaagaaatataccatgttttcttttatttagtatattaataaaaacaataaagatacacatgcttcagaatggaaagaaaggtgtttacttttaacggcagaacatatcaatcacctcattattacataatatattatttaaggtcaagtgtagatgctcaagcttgtaatcccaaagctttgggaagctgaggagaatgacttgagctcaggaatttgagaccactctgggcaacataacaagaccccatctctataaaaaggaaaacaatgaaaataaaattagtcatgtgtggtagtgcccacctgtagtcctagacccttgagagactgaggcagaaggatcacttggatgcagggttttgagtctgcaaggctgcagtgagctataatcatgccactgtactcaggcctaggtgacagagcaagaccctgactttttaaaggaactgtatttgcttctattaaacaggtcacaaacactctcaatagttttttttctcaaagttgagatatatggaacaagtttttaaaatttcaccatattgataaaattatcccctaaatctatccagggtaatatattatccacaataacatattttcatatcttctttcttttactccttactggttttctactgcttcaataatttgtttttctctttattctatcttgattcatgtctagttcttgtttcctatgatatcctccttgtaattttaacccagttcatccctctaatcttccattcagtatctctctgctgtgtaggaagcataactgtgctgagttcttggctggaccactgaaatcaagtaatgactgaatataaatcagaatcatggctgtaaataaaaagaatgtgaccaaatgtccattagcaatgatagtctagtcatataaaaatgtggctattttcaattaataaaacaaaacaaggaagaaaaagtaaagacaatgtcaggaacgatgataagaataagcatgtaacaagcaaatggtaggtttgcttcaaccaaatggtaggtttgctttcattacatgaaaattttaccaaattgtacatataaagtcttctaagaacaatatacaaataacattttagtatataaattggctcaagaaagtcatttttcagggactctagatttataggctctttaagtctctttaaaactgtaaatgacccacagaagttggctgccctaaaggtttagattaaataaaccatccagtgcacaattcaaatataagctgaacaaccttaattggaatatctatcctgtgcggttttccagtttctgatttggtactccccaagtagcaatttcctatgaattaccgtttcccaactaagaggtacagaaattcccagtttctttaggaggctgaatattttaaaacttcggctttattaaggttttcaacaaagttctaattaaactacacttcattaatggcttacccccctaccttagaataaggagagctttcttacaattattaaagctaaccttcagaactgttgttaataacaagactaagaacaatttttaattttttttaacttcatagctgtaggctaaccaatagttaacaaataattcattcatttcattggcatcatcagtcctcctagcaatatgtgttttttttttttttaatttaagacttggtgggggaggcggtgaggactgtgcaattactagtcactgttttcccactcattggtactattagcttaacagataaaaccacagataacagccgcaatcaacttcagcaggttcccagaggcaagctcttgctttttgctgattagcttcattcaattatgtcttcttaattgttcatgtgctacagctcattaaatgaaaaataatattcctttcctgtgggtagggcacttgagatttgaaaaatagccacttcatctctgcctcagaggcacaagtaagttgatctgatggtgtctgaaaaagctcaacagatttgtgcagatagccctgcccgagaagggacaataaaattaataaaattgattgttaaatcaagtcaaaaataaaattactcccagtattttcctttaagattaattttcaggaaaattagacccagttttgtagcatttgattatgttcacctctgtaatataattttctttgtaaaaagatcagttattgctgttccattacagatgggatttagggaaagtggagtaaatttttaaatttttctgaaaatagattttgacagattaaaaagtgtgtcacacaatttatttatgaaatattctagaaatggagaaggtaagtttcattcattaaaatagattcattgagtacctactatgttccaggccttttgctacacaatgaggatacaaaaggtcttaacttcaagaggtttattagtctggtggagtagaaataataattcaataataatccattagctaatatatactggctatttactaaggacctataaagtacttggtcgatatgtgtcaccttacttaatctttttaacgatcttataacatagaccatatcatattttttattatagatgaactaaggcttagaaaaattatattgcttcctgatatcacataactagcaaatgctaaagtttagtttgggacaagatatgtatgaccttgtagcattcctatttacaggtactcctcaatttacagttcctatatgcatacatttcagtcaccatgtttagttaagttagaccagttacccagctcaagcgattctcccacctcatccttctaaagtgctgggattacaggcatgagccaccacacctggacggatgtgccatagtttgtaaaagagttgagaatggctgctagctagtagaaaaaaatggtgatattagaaacatgggtatattttcaaatgaattccaaaagtttgagaaagtaatagaatttttgtctgttttgttctctgttatttcgcaaacacagatactcagtacatatttttgcttttttttaaggagatgaaaaagtctgacatgattttataaaaaataaaatttcaaatttcagctaccacagtgtattaactgtaagtaattacataagtacaaattttgctccttgctctttggtccaaaatcattatgtaaataacaggtgtgcttcatgatcagtgaccattggcatcatctttttaaatgtctgtcagtgattgatcactacacatctattattcatcacatgcagacagaaaagtgtgcagttatgttgtctctgtttcccattgataaacacaagtgccatttcttaaaaataaataattgaaagaattggccagaaaagataaaagtacaacataaagtaaaacgttgagtccagtgaaaatggagctacagcaaaatccctgtgggaatattgacactgctgccatctgaggaacttaagctttgcagccagaacaacttagtgcagaggagcttattgacataaatgaagaaagtggatgtgatgaaaaggatgaagatgtatcaggctaagtgacgccagcaaaaacccaaacacacaataaaaaaaaaaaagacttacattaaaggaacttacagagatacttaacaatattgaaagcatcaaagcataaagtgatgaaagctgatccaaatttaagattatgacaatttgccaaggcataaaacattgcccccttcattgtaagccatgtaagaagaaatcaatcactattcaaactattagtaaacattttttaacaaacaagtaaactttaagtctttaacatcaatgtaattaagagggaattggccagcatatgtgaaagtatagcaaacaaatgaaaataatgatgcaaaaaataataatgtaagatatgagttgaatataaacagagttatagaaagaaagaactgactttaattcttttattcccagtgtaaattccaggatgttaaatgaatatgttttataatttatttattttcctacacatttgtaagtgacagtaaaagagtttctaatattttgaaaagaaattaaaggttatggaataatatttattcttgattattaagataaacttgcatgatttcagctgagattatcatgtttatcatccttcactaccatgtaaagcgagaagtgtgggtattaacttattatctgtttgtttaaagtgaatgacacacagcttagtgttacatcaacagaaaaatatttaagaggaaatgacactaaatcaattttaagataatgcttctattatgtatgtttctgtatcgtctttctaaacataattatggaaaaggcatcccaactggtgacataattattgccaataatataatagtaatgacaatatatttgttggtcaattaaaagtaactacattagctttggtaaaactacatttttcacttacatgattaaagacacttatcagtgctcttgtgatcctactttaagatatacatcttcatattaatttgtaaatgaaatgtgggagtttttcataaccaacaggtttaaagctgtgtgaagatatgtgagggaaatatatagttatgtctgtaagaatcagtgatgtgccatactttgtgttttgttgttattgttttcttgagacaggatctcactctgttgcccagcctggagtgcagtggcatgatcacagctccatgcagcctctacttcccactcaagcgattttcccacttcagcctcccaagcagctgtgactacagttgcatgtgaccacacccagctaatttctattttttgtaaagacacggtctgactatgtggccggggctagtcttgaactcttgggctcaagcgattctcccacctcatccttcttaagtgctggtattataggcataagccaccacacctggactgatgtgccataatttgtaaaagagttgagaatggctgctagctagtggaaaaaaatggtgatattaaaaacatgggtatattttcaaatgaattccaaaagtttgagaaagtaatagaatttgtgtctgtcttgttctctgttatttcccaaacacagatactcagtacatatttttgcttttttttaaggagatgaaaaagtctgacatgattttataaaaaataattttgatgttagtaatcattactcaacatatttttgaagagtctaaaggaaatttccactgtttcaaaagatcccaccttccatttctctctatctcatctcctagcaatctacccttcatttattgtactctagttgtgcttatctttttggtctttatcaaacacaacaaatattctgagaccttaatatttctgttccctctccctggaacactattcctcaagaaataaaattaggtaattatttcaatcaagctggtatttaaacatcttctgctcaaggaggcctagctgataatctgtatttaatgttccagttttcctatactctctctgaacccccattggccattctattttgttttatccatagtgcctatcacctgttggcatattatatgaactctttgtttattaacttatttgttaattttattgtttatcatttatgtctatcaatggcatgtagactctaagagagcaggcatatttgtgtgtgttattcattgatatttcaagattaccaaacagtgtctgtcatatagcaaccattctttttttatttttttctgagacagagtcttgctcccgggttcacaccattctcccacctcagcctcccgagtagctgggactacaggtgcccaccacacccggctaatttttctatttttagtagagacgggctttcactatgttaaccagggtgatctcgatctcctgaccttgtgatctgcctgcctcagtctcccaaagtgctgggattacaggcatgagccactgtgcccggcccgttcattacgtaagaataaagaaatatccccttgacatgaaattctgtgtattggaataatatatataccatggcaatgagcatttgtcattatcttagtcagcagtatatattttcctagacaatgaaaagactcccaactggccttttgtatgacaaaaagaactgctaatcactttcccagtttggcttttatttatctccagattaaagtgttattaaggattaatttaatgttattttattccatttagtgaacttttaaacaataaaacacttttatctatgttgttttgcacccatatgacaataaagtgttatcatgcccatactataagtagaaaaacacaggtagaaagaacataactgatttgctcaaagtcatataactcagaagtgaccgaatacatttgcctgactccaaaacttggtctgattttatcatcccttgctggctgtcagatctgatatatcagtccaaaaattacctcttgcttaaaccgatgttttggatgacttttgtaattttctgcgttccatcatttattagcgccaatatataaatggttatttagaatacagaggtttacacatattcgggaccaacattccaaaaatggcttaaatatttctggcagcctaatattatctacggagaattattttcctcaagaacattagtgagatgtgctataataatggttgagcaaagtagcacaacactagatgctgtgtaactctgggaacaccttatttcctgctctgatagaaatctgttaaagaccctcatctgttacaggcagagagaagagcagagtaaaagtgctttgcctacctaaagggattgttgtaagaatctgatgagttaaactgtgtgaaagcattttgcaccctctaaatccatacatttacatgtgacttccctgtatgacacaagctaacaaacaaactagaaacaagcaaacaaaaaaaaaccgagacacaaaaataaaatatctttctgttacctcatttgggaaggggtctaaaaacccagaaataatagtatttacatgtacatgtagttggtaaacattcaatggagtaaaaagtaaattaaaaataataccattagcagaggggaatgtatttttacttatgcatatatacccacatattggatttgtctctatttcatctgtaggacctagccactagccaaatgcccgaagcccctagaaccccagtgcctagtgtggtatgcagaaaataatgccctgttatatgtccattacctaattccaagagccttggaatatgttaccttacctggtaaaaaggactttgtagatgtgtttaaagttaagaacctccatatggaaaaactgtcccaaattatctggatagacccaatctcatcacattagttttaaaaatattaaaccttccttggctgtggtcagggagagaaatgtgattgtagaagaatggcaggcaaatgtaacattgctagttttgaaaacaaaaggagtccagaagtcaagggacgtgggtggccactataagctagaaagatcgagaaaactgattctcccctagagcctccagaaagtagcattaccttgccaatttaacctgattttaatcgtcagacctgtgtcaagcatgtgacttagagaagtataagatattacatttgtgttgttttaaggcactaattttgtgataaattgctaagacagcagtagataactaatacagctagaaaacaattttaaaatacattttaaaaagaacttcaacatgccaatatctaatgaataaaaccaaaaataggatgaaaaattaaaatgaaacttagaatttttctatattacatatttgggaaatttgaattatttcataatattctgatctcaaaaatatgaaaaaagtagcttgtctagttatcattcacctgaaagcaactgttttaaacctgtcattacaatctgataaaaagtaatatgtctcattcagtcccaactacgctcaacatgacccaatcttgtcagaacccaatgtgaagcttcaagtgtacaggaatttacaatgacaatgctccatggaattttcaatgacaatcaatgttccaaaaaagctatgacctacacttgaggctatcccaaggagaagcaaatatcatagcagcatcttacatttgtgaacacagtggtaaatatagagcatacaaaaccatgcatgggtattttcttctgtttttaacaatggataatgaatgtcaaaagtgatattcaaactagcaatatgcaagttaaaattaaatccataaagcacagcaaaataagcatttgttccattgtagagctcacgtttccttgagcacttattttctttcttttccctcctctctgctcctgtcccctcccctccctccttcccttccttcctcctttcctttcttccttcgacttccttcctgacttccatttttcttttttcagctttattgaggtatagctgacaagtaaaaatgaacatatttaaggtgtgcaacttgatttttgtatatgcatacattgtgaaatgatcatcataatcaagctaattaacatatccatcacatccataatgtaaaacatatctaatgttgtacattagatatactgttaccatgctgtacaataggtatatgccacattttccttattcatttatctgtccatggacacttaagttgtatccataccatagctattgtatataaagctgaaatgaaaactaaagcaaatatcgattcaaaattattttatttcctttgaataaagactcagaagtgggattgctgaagcatttggtagttccatttttaattgttaaaggaatcttcatattgttttccataatggccacaccaatttacattcccatcaatatgtcttcctttttctccacttccttcacaaaatttatattttgaagtttgataatagccattcaaacaggaatgtggtgatacatttttgtggttttgatttgtatttcctgataattaatgtcattaatctttcatctttcatctacctattgacctgtcgtctttcatctagctgtttgccatttgtacatctttggattaatgtccatttttgtaaatttatttttctattgagttttgtgaactccttatatattttgaatattaccttttatcagatatacagttgcaaatattttctgtagtttgtcttttcagtctgttgattgtttcttttactgtgcagaagctttttagtttgatgcaattccacttctatacttttgtttttgttgcctgtgcttttgctctcatatccaaaaaaatcattgccagaaccaatgacaagaatctttttcctgatggctttttgctattagttttacagtttcaagtcttatgtttatgtctttaatccattttaagttaatttttatttttgtatgtggtaagagcttatcttcatttttctacatgtggatatccagttttctcagcaccatttattgaagaaaataccttttccccagtgtgtattcttggtgcccttattgtaggctggtttactctaagtgcatggatttatttctgggctctctgttttcttgcattaatctatatgtctgtttttatgcaaattccacactgttttgattagatttgtaaattattttgaaatcagaaagtgtgatgcctctagcttgcttttcttgctcataattggtttagctatttgctatttggagtttattgtggttccatataaattttagaattttttttcctatttctgtaaagaatgccattggaattttgacagggattgcatgaacctgttgattccttttggctagcatggctactaaaacaatattaattatttcaattcataaacatttattttccatggatgaatgttttttcatttatctatgctttaacatttttccttgattcctcctccaagatggccaactagatgcagccaggagaaacatctcccacagagggaccacgacatcaggaagacgggtgtacccctagtaaatcttcagagggaaggcattgagagcagatagagagaagatacagaaggtgggataaagggagatgaagctgggaatgctgcatgtggctaccacacaccaggactcattcctggctcccagcaactcctgtggaaggggtgagttgaacagaaatgagcaactcactctcaccatgagcctctggaatcatagcaggaggagtcttgtcagccaccatggacacttgagttggcagagaaagctacttagtgaagtggtagggacagaactccagctgcagcagagcccatggggtttggtgcaggagcatctatagtggagaacagccagggatgcccatccccctaggcttgatttgctcctatagtagacattagccctaaggaaaggggtgaacgtagactctgtagagcagtcttgcccatgagatgagccaggccccctgagcaccctttggtgtgctgtcttctctttgggccccagcctgcctgtacctgctagcagtgtacccccccaggcacctcaagggggcctgcctcattgctcctgcactggtggactgcagctgactgggagagtgctccagaagagcaaaccctgtgtatacatataagactgcccatgtcctccccacactacagcctcctccatactgctttgctggcaggcactcgctgccagcgatccccatacatctctttgcctgtacatgtgtttgcagacagacctagcctttccttctctgacagtgcatgtgtacacatgtaccatgccatgccatgccactattgctggcttgagtgtgccccatcccttctccccctgttgcactgccatttttgttggagcattggagggcatatagtttgacagctctgccaccaccagtgctccactcctgtgccaaaactgctggcatgaaactaagcacagaaaacagtgtatctactcccatccctgagaggtcactgctgtaagcaagaatgctcacagagggtgcacacagtcctgcgaccactagcgccccatccctgtgctaacaccagcaccagtacaaatgtgcacaccattgccagcagggccctccaccttcccaaaccataccgccacagccactactacaaacacccacatggaggctgtcatcttccatgtggatggaggatgccgctggtacatgcaaatgtggacacatcccactacgactgtcctacaaaatgctttggctgggagtagccattagagtgttgtgaccagcagtctgagatcacattgacccctccagtgcagcaggttcctaaacttgatccacaggtaatagctggtgtatgataccagtctcccagagttagagcacacaatgcagagtgctgagctgagccttggccacctgaagtcttccactaacaaagccaggtgactgaacacagcttataccataatcaaaccctcaaggtcataaaatagaataaaagaaaaaaaatccaaaggacagcaacttcaaagattgaaggaacaccagcccacaaagatgagaaagaaccagtgcaggaactctgacaactcaaaaagccagagtgccttctttcctccaaatgagcacactagccctccagcaagaattcctaatgaggcagaggtagctgaaatgacagaaatagcattcagattatggataggaataaaaatcattgagttttgggagaatgttgaaaccacatctaaggaagctaagaatcacaatattaagatacagaaggtaacagacaaaatagccagtacagaaaaacaaacaaacaaacaaacaaaaaacataaatgacaggatagagctgaaaaacactctacaagaatttcataatgcaattgtattaagagaagaataccaagctaaggaaagaatctcagagctcaaagactgtttttcttaaataagatggtcagacaagaataaagaaaaaagaataaaaaggaatgaagcaaacctccaggaaatataggaatatataaagagaccaatattatgactcattggtgtccccgaaagagatgagaagaaagaaagcaacttggaaaacataagtcaggatatcatccatgagaacttccccaacctaaccaccaatattcaaattcagaaaatgaagagaactcccacaaagtacttcacaagaagatcatccccaagatacataattatcaggttctgtaaggtcaaaatgaaagaaaaaaatgttaaaagtagctagagagaaaggacagatcacctacaaaaggaagcccatcagactaacagcagacctctcagtacaaatcctacaagtcagaagagatttgggacctatattcaataacctaaagagaagaaattccagccaaagaaatttatatttggctaaacaaagcttcctaagtgaagggaaatatgatccttttcagaaaagcaaatgctgagggattttattaccaccagacctgccttacaagagcttctggaagcattaatatggatgggaaagaccataaccagcaaccacacaaactcacttaaggacacagaccagtaacactataaagcaaccaaacaagtcagcataataagtcgacagcaacaggataacaagatcaaatacacattaatactaaccttgaatgtaaatgaactaattttcccaattaaaaggcacagaatgtaagctggataaagaaccaaaacacaattgtatgctgtctgcaagagacccatctgacatgcagtgatgcccacagaatcaaataaaggaatggaaaaaaatctgccatgcaaagagaacacagaaaaaaagcaattattgcaatcctaatttcagacaaaaaagattttaaaccaataaaaataagaaatggcaaagaagggcattatataatagaaaagggttcaattcaacaagacctaactagcctatatatacatgcacctaacacagaaacattcagatttataaaccaagttcttagggaccttcaaggagacttaggctactacacaataatacggggaaattttgacacccccactgacagtattagacagaccatttaagcagaaaattaacaaaaataatcagaacatgaacttaacactggaccaaattgagctgtgaaacagctacataactgttcatcaaaaaacaacataatgtacattcttctcatgtacacacaacacatattctaacaatgaccacacaatcaaacataaagcaatcctcagcaaatgcaaaagaaacgagatcataccaaccactctcttggacaacagcacaataaacatagaattgaagaacaagaaaatcagtcaaaaccatacaatcacatggaatttaacaacctgttcctgaatgacttttgggtaaataatgaaattaaggcagaaatcaagaagtattttgaaattagtgagaacaaagatataatataccagaatctctgggacacaattaaggcagtgttgagagggaaattcatagcactaaacacccccatcaaaaagttagaaagacctcaaattaacaacctaatatcatagttaaaaagctacagaagcaagagaaaaacaacaacaacaacaaaataacaacaaaaacaaacaaacaaaaaaacccaaagctagcagaagataaaaaatacaccaaatcagagctgaacagagactgagacataatacaaccattcaaaagatcaacgaagccaggagttgactttttgaaaacattaatacaatagatagaccactggttaaactaagaaagaagaaaacagagaagatccaaataaacagaatcataaatgagaaagggaatattaccactgaccccacaaaactacaaataaccatcagagactactatgaaatcctctatgaacacaaactagaaaatctagaataaatggataaattcctacacacatacagtcttccaagctgaaccaggaagaaattaaatccctgaagataactataacaaatgctgaaattgaatcagtaataaacagcctgcaaaccaaaaacagccctagaccagatgaattcacttctgaattctaccagatgtacaaagaagagttggtgcattcctactgaaacggttcccccacaattgagaagggacttctcctcaactcattctatgaggccagtatcatcctgataacaaaacctggcagagacacaacaaaaaagagaactttaggccaatatacttgatgaactttgatgcaaatatccttaacaaaatactacccagctgaatccagcactatatcacgaatccaccacaatcaatattctttatccctgggatgcaaggtttgttcaatatacaaaaaccaataaatatgatttataaaataaagagaactaaagacaaaagccacatgaacatctcaatagatgcagaaagacttttgaaaaaattctgcttcccttcatgttaaaaactctttacaaattaggtattgaaggaatatacctcaaaataataagagccatatattgcaaacccacagccaacatcagactgaatgggcaaaagctggaagcactgtccttgaaaaccagcaccaaaaaaatgatttctccacttgctatttctattcaacacagtattggaaattctgaccagagcaatcaggcaagagaaagaaataaaaggcatccaaataggaggagaggaagtcaaactaatcctgtttgcagatgaaatgattctatatctagaaaagcccagtttcagctcgaaagctctgtaagctgacaaacaacttcagcaaagtatcaaggtataaaaatcaatgtacaaaaatgactaccattgctatacatcaacaacagccaagctgagagccaaatcaggaatacaatcccattcacaattgccacaaaaagaataaaatacctaggaatacagctaaccagaaaggtgaaagatctctacaatgagaactataaaacactgctaaaagaaatcagagataacagaaataaatttaaaaaaaaattctatgctcatggataggaagattcaatatggttaaaatgaccatattgcccaaagcaatttgtacataaaatgttattcctatctaattagcaactacattattcctatccaattagcaattacattcttcacagaactagaaaaaaaatcaattttaaaattcatatggaaccaaaaacatagcccaaataatcaagggaatcttaagcacaaagaacaaagccggaggcatcatgctacctgacttcaaactatcctacagggctacagtaaccaaaacaacatggtattggtacaagaacatatgcatagaccaaaaaaacaaaacagagagtcaagaaataagtctgtacagctacaaccatctgctctttgagaaaactgacaaaaaataagtaatggggaaacaactccctattcaataaattgtgctgggataactggctagccatatgcagagattgaaactggaccctttccttacatcatatacaaaaatcaattcaaaatgtattaaatacttaaatgtaaaacccaaaactataaaagcactggaagacaacataggcaatactattctgaacataagatctgacaaagatttcatggaaaatatgccaaaagcaatcacagcaaaagcaaaaattgacaaactaattgaaaaactggtacactagtctccagtgaaagcaactgcacctgaagttaatggaaagaaagaaggggaaaaggaagaagaagaggaggtaaaagatgagggtgataagttagaccaagctgaagagggaggatctgagaaggaagcctctagtgaaaaagaggaaggtgagcagaaagaaggagaaacagaggctgaaggtgaagtagaggaagccaaagctaaagaggaaaagaaagttgaggaaaagagtgaggaagtggccactaaggaggagttggtggcagacaccaaggtggaaaagccagaaaaagccaagtctactgtgccaaaatcaccaaaggaagaggcaaagtcaaaagcagaagtggggaaaggtgaacagaaagaggaagaaaaggaaatcgaggaagctcccaaggaatagaaggtagagaaaaaggaagagaaaccaatggatgtgccagagaagaagaaagctgagtccctggtaaaggaggaagccatggaggaggcagtcaccattaccaaattggtaaaggtgcacttggagaaagagaccaaagaagagggaagccacagcaacaggagaaagaggagaaagtgggaggaaatggggaatgagaaggaagggagtgataaagattccaaggaatccaggaagaaagacatagctgtcaatggagaggtagaaggaaaagagaagggagagcaggagaccaaggcaaaaggcagtgggagggaagaggagtaagacattgtcaccaatgacctagacttaagcccagcagatgaaaagaagggggatgataaaaatgaagataaagtggtggtgaccaaaatagtagaaaaaatcaccagtgagagggagatggtgctaccaaatacatcactaaaactgtaaccatcactcaaatggtcgaagagcatgaagagacctttgaggagaaaccagtgtctactaaaaaggtagaaaatgtcacttcacatgccgtaataaaggaagtcacccagagtgactaagatttgagtccactgcaaaagtttaagccatacgacaatttcaaaatgcatgtgattgacagcttcaaaacagaacagattctcccataggggctccagacattgtattttactttgtgcaatatgaggagactgcatgcaagctcagtgtgctcccccctcagtctttgggggattcaaatgcatgatactgtatgtacctgggaaatttaccaatttcctgcactgttggaagggggtcactcagaaggggagatgtcttgagatgtattatgtaaagtaccaactgagccaaaaacaataaatgaaacacagaactctcttagccttaagaaagctatatatgaataattatgtttaccacactggtgcatttaaaatggacttttcttcatgggagaacctcgttgacacggacagtttgcaatcttatgttgatcgatgtgaaatgtcatagcagtacttgctcaataaaggtcatattggaaacatagtcaaaaaataaataaatgaaagagcttctgcacagcaaaggaaactatcaacaaagttaccagacaaccaatagaatgggagaaattatttgcagattatgtagctgacaaaggtcgattatctagcatctataaggaatttaaacaaatttacaggaaaaaaacaaacagccccactaaaaagggtgaaaagtatatgaacagacacttttcaaacacaaaaacaaaaaaatacttgcagccaaaaaaaagtattttaaaaaagctcaacatcactgatcattagagacacgcaaataaaaaccacaatagaaaacatctcacaccagtcagaaagctttttattaaaaagtcagaaagtagcatatgttggcctggttgtggagaagagggctcacttttacactgttggtgggagtataatttagttcgtccattgtaagaagcagtgtggtaactcctcaaagaaccaaaaacagaactgccatttgacccagcaatcccattactgggtatatagccaaaggaatatgattgatgtattataaagacacatgcccacatatgttcatttcagtaaatgtggtacatatgcaccacggaattctatgcagtcataaaaagaatgagaccatgtcctttgcggtaacatggatggagcaagagaccattattctatgcaaactaatacagggacagaaaaacagaaaacagaaatactgcatgttctcacttataagtgggagctaaatgatgaaaacacatggacacaaagacagcaacaaccagacagtgaggccaaccagaaggtggagggtaagagggagaggatctgaaaaaagtagttattagctactttgcttagtacacaggtgattaaacattctgaatatcaaacccccatgacataattttacctatataacaaacctgcacatatacccctaaacctaaaagttttctaaaaaagaaaaatgttgtattttgcaaaaagtaaacattttcctttattaatactttataattttcagtgtatgtattttcctgtttgattaaatatatttcaaagtatttattcttattattatataaataggatttttaaaatttcctttcagataatctatttttagcctctacaaatgccacttacttttatttagagcaactttactaaattcatgtattaattgtagcatttttggttgtcattgagacttttagacttttctgcctatacacctatatgtcaactgtaaacagagataatattactgtttcttgtctagtttgaatgtctttcatttctttttattgtatcattgttcttgactagaagtggcaagagcaggaaatcttgtacaggattttagaggagaggcttttgggttttccccattgattattatgttatcagtgggcttttcttatatggctattattgtgatgaggtaggttttctctacacctattgtattgagagttttttaaattagaaataggtattaaatttgacaaatatttttccagaacttattgagatgatcatatggtttttgtgtttcattctgtttatgtagtgtatcacattgaatgacttatgcatgttcaaccatccttgcaccccagggataagtcctagttggtcattgtgtacaattttttcaatgtgttgttgcattcagtttgcttgtattttattgagcatttctgagtctacattcatcaaggttactggcctgtagtttacttttcttgtggatgtctttggttatcaggtcgatgctggctacatgaaatgagtttgtaagtgttccatcatctagattttcaaatagtttaagaaatattattaattctttgaatgtttgctggaattctcccacaaagccatgcagtgctggactattctatttcttcttcaatcttggtaggatgtatctttctaggaatttatgtattacttcgcatttatctaatttgttggtgtatatttattcataacagtcccttaagggctctttttatttctgagacatctgttgtaatgtttcctctttcatatacagttttatttatttcagtcttctctctctctttggttactctaggaaaggatgtgtcagttttatttgtctttttcaaaacacaactcagttttgttgacttttgaaatagcttttttgtcctttttaaaatttattttttgccttaattagcattatttccttctttctgataatatttgggttagtatgtatttttttctgtctttggctagttatttttttaggttgtttatttgagatgtttctttttttttttcttcctcagaaacatttaataggtattaacaaacagaagccatgtctctcgaggctgtgagacaagatggtggatccccatgccattaacccccagaacccagggcttatatactataggtaaggagaattgaagtaatttggtcagaatttatggtaagtgtgtgctcttaacagtagtagagtaaaaatcttagaggcattcccagaaccgaggttaatgaaaagccaacatgttggattagcatttaagacagaattggtttagcctgtacactccacctatctgacccagattttacaatttcacattctctcttcttccaagatggtccctgagcctagagagaggttgtttgatattgcacagctttagcagtagtgcattggcaatggaaaacagattgggcccagttgctataatgttccttctcagaaatacttttgctatatctcacaactgttggtatgttttcttttcatttttgtcaggaggtaatttttaattttttaaatttaatcttggacccaatgattgttcaagagtgtattgtttagcttccatgtatttgtgaatcatatggtttcttgtttctttaccattaactgatttacactttcactctattgtgacctgaaaagatacttgatacagtttctatcatcttaaagttgagttgttttgttatctaataggtgatctattgtgaagagtgttccatatgtgcttgaaaagaatgtacaatcttctgttgttgggtaaaaagttctgtagatgtctgttaggttaatttggtctctcctattgttcaagtaagctgttttccattgatttctctgtggatgttctgtccattattaaaagtggaatattaaaatcttctagtattattgtgctgctataaatttctccagttctgtcagtgtttgctttaaatatttagatctgatattgagtgcatatacatttacaatagttatatcttcctattgaattaacctttttatctttatgtaatgaccttctttgcccctggagacagtttttgacataaagtctattttgtctaatgtaagtatagccattctgctttcttttcattaccatttgcataaaatatatatttttccatcctatcatgtttaactatgtgtgtccttaaatagttggtgccaagtttttattctttcagccagttaatatcgtgtgattgggcagtttaatccttttacatttaaagtaactattgatagggaaggatttactattgaaattttactgactgctgtttttcttgttcctttttttctttcttgatgtcttattttgtgtttctttttttgttattgttgtttgacaggctttaattcctttctccttttcttttataactagttttttaactactgtaggtagtagattttcttttttaagtactatggctattttctgtgtgaatgacatgagtcttacataaaatataattataataatctaaaactgataacttctcttccacacaaaaacttcacatttttaccttgttcccattatagattattgatatcagaatttacatatcttaacatgtgtatctattaatgtaattttagttatacctatatttaatacttttttaaattttagattagaattaaaagtgatttacctaccacaaccacaataatatagtattttttatttgcctctataaatttaccattaccgatgagttttatacttttgtatgctcttatattgttatttagcatcctttgatttcaacttaaagtactccctttagcattttttatatgacaagtctagtggcaataaactccctcagctttcgatttttttaattttgtcttaagttttaaaggataattttctgggtatactgttttgattggcagttgtgtatttgtttgtttgtttccgcattttaaatgtatcatccaactcccttctggcctccaaagtttctgctgaaaatccaccaatgatcataggagggttccctaacacataacaagttgtttttcttttgctgctttcagtggtctctgggtgtccagagtatgccagctctcatcattgccctgaaacaggtgagatactgatcctttttagtagtaaccataaatgttggggcactaactggattttccaatttcttctctcctcagggaaaagctgggtgtataatctgctcatgctgaactgagctggggaaaagaactatggcaaatgtttgcaagctcattcaaaccacagactttttcaaactgttgctttgatctctgtagcctccatgggcctaatggatgctgatctccattagttctcatagacacgtcagttgaaagctagttcctcaggtagcagctggaaaagttaaggggatagatatgtagataaattccttccagactgaagctagaggcttgcttttatcattagagtgagcaagtgggagaatttgtggaaatatccacatgcctgtttaaaatggctgctttgttttctatagcccacatgtaaatagtgaatggcaacaccaatagctctcatagacagtgagttagaagccagacctcaggtaggagctagaaaacttagaatgcttgatttgtagtctaacttctttcatagagaatctgggaactgggctttgttgttgtagctagttggtgaatgaggaggtgaagtggaggagatatgggaagaacccatttgtttgggcattttttctcaatgtaccttagtttgtctgtagtagctggccacagtagtgatgattctatttcctgagaggtgagaattgctgccaaagaatgtctgccatggatgagaatacaaagaaaggaaactaagaactctcaaagcagctactagaaacccttcatagaggacaagaattatcttcagttttgagatatatgagaatgattacaactcctttgagcaggcttcacatactgcccaaagatgcttctctagtttgtgtccttcttgctatcagaaagagagaaggaaactaaataaaacaaaataaaaattttagaattttgtgctgtcttggacatggaagcaatgggtcaggatcaagattgtggaaagatgccagttcggatgcaggctagaaaaattagtattgtcctcaactggaatcagcaaccaaaagactaagtgtatgtgtctctgtaggctgaagggttttcagatatcataaaagataagaagtcaagctacacttgtttggaagcatgtggcagagaacacagattaattgtttaaaggatggcccaaacttaaggccaagtcacatcaaacccatcagaaaccaaaagtgtggcagaattcctaacagaaggatgagagaggaagagccttatatagatctgtcttctgtttcacattctgactattctaaagcttttaatgaagaattccctagagtcataaaacaaaggctaaatggtgagtggctgcaaatacacataaaaatatagtgaattttttgaaaagatatactaatttcaggtggctagaaagatttattaacataagtaataaaggtcttttagttgtcaaagtaacttatacttaatatttattgcaattttaaaaaattaaaatgctaaaaattatttgtgaaaatgagttgttttatatgtttacatttaataacaatactttttacataaagaaaatacaataattaaatatatctgaactagtcaaaagataattataagatttaaaattgagtttatgtgcaataaatgtggtaaacaataatgtgatataaaatcttctaaatttaataatattcttggtagaggattctggggcaaaaatatgattttctccatatccctgcccactacccaatatatgataacatgtggcattattaaatatggaaaaatattaaagaatggcagtagactagagagaagagaaggaaaggcatacaggaaatccaggtccctgccctcagagacctctcaattcctggcatatgtttatgttttgaacattatgcaaatttgtctgcatgacaaatttattcttgtttcaggttaagagtagaaatcaacccatagtccttacgattagaattgccttagcataacgattcaatcagtaagaaaatataatagactagagggtaatggagattttaaaatttatattatcttaatatatttattagaaaaaatattagattgctcaataaatcaatggtaactttaaggcttttactgtctactacaaagaatttttatagatatatgaagaatgatggtaaggaagagatatgatgccatgaggcctactgtgagcaagacactgctaatcaggctattaggttggtccaaaagtaattacagtttttgtctttgaaagtaatgtcaaaaactgtgattacttttgcaccaacctaatacttccgcactttggaaaggctttgcctacatcattttggttattgtgagaagacttgcacacataaggaatttttcaaaataatattttaacttgaaatacttttctttgacaaatacagtaaaagtgatagagccaaaaagaggactaggcatagccctgaggggatttccgagcaaaaaaatcccaggggatttgtatgcaaacacttcgctcaataaaaggagaggccaggtgtggtggctcacaactgtaatcccagcactgtgggaggccgaggtggctggattgcttgagcccaggagtttaggacgagcatgggcaacatgacaaaaacttatctctaccaaaaaaaaaaaagaaaaaatagcggacatggtggggtacacctatagtccagccacttagagaggctgatgtgggagaaacgcttcaactcgggagtttgagacccgcctgggcagtttagtgaaacctcatcactacagataataataataataattatctgggtgtggtgacacacgcctatagtttcagctactctggaggctgaggtgggcggatagattgaacccaggatatctaggctgcagtgatctgtgatcatgccactgcactccagcctgggtgacagagaccctctcttaacaaaataaaaaatacaaaaaggagaaagtcatcaaacaaaatgatgtgacttagtctggtaatattcgtcaagaagtcaagatttatgctctcttacaattctgactttcacattgaattaaattaagggtgtcttggcttgtttagtgtagtttagtaaaatacagtcatttgttttccacagctattatattattctccattaaaaaaagaagaagaagaagaaatgagaaaaaaaaatcagtccctagctagaaattttaagagtcaataacatttgggaaatgaaaatatattctgaagtagtataatcatacccaaatttttagactctgtactcaatctataagatgtatgtgagcaaaatattattagaagcaacatgaatgataatcacgcactacaagcgcacgaataatgtttccctgaaaggtacaataaaaaattattcaatgtgaaacaaaacgttgactgcaacaattattaaaatttgactattgaattgtcagtatactcaattatgaagacatttggaaaatataaatgagcactactgtttttgctcattttttaaaaatgaaaatttttggtaatgtctgacctgaaggcagatattcattataatagtcaaatatcataaatacatttcaaatgttatgtattctacataaattactcaggagaggaacatgtaggctcataaacttgcacacaagtaaaggaatgtttcttaggaaaaaattctgtgttaaagatattccacaccaatgtctcaggaaaaggcatttgtagtatactgctccattacctatgcttcataaaaaatgcagctatctaatttaatttagctctgaacagatttcttagcagcataatttatgttttgagaatatctcttaagaatcatagcttgcaatctatggtgcttcaatgaagaataatctgtaaacaaaatctccatctatcaacaaaggccattaaagaccataaaataacccatccttgactgattaatgctgctactgaaagggatttcaggctattaacatccagaaaatatactgccactgtggttgcatttattataaatcacatagttatatgtactggtgtaaagcaatgttttcttaaccacctccctctcccaaattaatttaataacaaagatactttgaagaacactaaatatctatagaaagtaaatgattctatttttttccctagaggaaatgtatgtgaaggcagggctatttataatacattagatagctaaatattggtttaacactttatatgcagttcaattatgttcatatatttatgtcattaaaatagtttctctaatgtaaaataaaacattaaattcatttgtatttcttgatacttttattaacaatactgatggtttttcatgggtaaaatagccatcaaaaattgttagttgttacctttaggttcatcctattctgtcaatttgattgtcactaactcttcctcttaggggatgtgaatatagctgttgagctcatactcttggaaggtaaagaggctttgtttactggtgcagatctcgattttttcaaatatagtatttcacctcagaaatactatctattagctcttatgccttacaaaactactggcttggatttgtccaatggttttaacccttgatcttacctttaacatgcttggaatctcacaaatattttcttatattgtttagtacaaggcactgtctaaatagtttagccacattatctcattccatttacaccaatcccatgagataggtacgttttaaccattttataacataagcaaaactcaatttcaagaggttaactaatatttccaagatcacatagctagtttatggcagaggaggattcaaacacaggactgtgttgattcaaaaatctatagagttaaatgtgtacttgtccttccgtaatatctgaggctagacaaaacaatccctggcttttctctcctgctttctatgaatattctgtcttagactacttagtcattatatatttttgtcttttcagtagagttctgttttgctgtgctagttcttttgggtttctataataataaaaataataataaaaggagaatagaagaataagagtagatcagggagaagatattctgaagataagttggtttaaagagaatgagttaatggatcagcttttgtctctgaagtcaacaaatgacaaagaaatgaaaaaggtgtaccctggaacaatgcatctatctgctggtagtacttgagaaatacatacaaaattcatatttttattttcttttgtttcattttattgcttattttggtcagtgttatttgcttcttatactagtaacattcctccagcacagaacaacatatctttgcaaatatttcattaaatatataaatgtcttaaataccacaaatgaaagacatgagtaacacaatatagtccacaaaactcaaaaggaaataaacacagtttagcatttttttcttacaattgaaaagattttaataactgttgagtatttataattatctatgctaactcccattttcttgccaagttatgtgtctttaaacactatggagtccccttgcaaaatttaacagagaagcaaagatatgtatcagtaatattgatgtttttatttttttaaaaaaaacctccctgataatttaagtgaattggattagaataattaaaacagaaatgaaggacacagaagcacatattctcaatatcgtcacctctgattactttagaattctgttagcatgtgctgtaaaaatcctttttaaaataaatattcccactataagcttaagtttattcatatctagggagaattgttttgttcggataattagatcaacagctgactctttaagctgagataatggcccactagccaataggaatcacacatgttaaggagaacagaattcaaagagtctggtcccttttgcacagtgacagaacatatgaggcagctacatatctagagagacaagaagataaatataagagagcaaccaaatcaagatgtaattactctgcatttaatcaaggcaccttagggttagtccagaccttttatccaaaacagctctgtaaacagcctactaaaccagcatcatcagctttctgtatttctcatctgtctaagtcagtcttccttgtttcaccatattcctacttgttttgtcttcaacactttctgagagaatgaagaaaaatgacaaaaaacaaattgtatgattgtatgaatgattaatatctcctctttcatgttgttcctcttctattgttcaaagagtatagagtgaataaatacaaaaacaaacacaacactgaagttaataaataataaggtccatctcatttgttaaatttcgtttcttaaggtatatgtgtctttgaaccttctggttatttctacaaaatagttctagtggctttggcagagtggtagcataacacatcactttttaaacagagttgaataattgtataaccctaaaagtaaaagaggcaaacaataaaatgaaatgaacaaatgaaataaaatcagaaattctcagcttaacaaaaccacctttcttgtgagcacattttgtgcatagtgaaataagggacatatctctaaagctctgtacacatatatttattaaaataaattgaattaacaattggcactacacagagtggcatgaaaaggttcagtatcttaacctcagctattcactaagataaaaggatcaccaacataaaatcttttttctttgcattgttaaacttaaataagtgttttttctctaaataaaatgattaatttttaattatgtagataaattttggatctaggtggactggaggcataaatgacacttacttagagatataaccagcaaagtcaagatggcaactttacagaaaaacataatctaaaagtttgaaaaacaaactgcagaatatattgtgtgtggctctttttatattctaaactatgttataaaaattttgcctcgacttacttatataagaaaaataaaactggttgcagaaatataatttagtattatgtcttgtgtgacctaacaattgggtaacaattatactaaaatgggacataatttattaatttacacagtataaaacctattggaatagactttgtaagttccaagtaagtttcttatcgtacctggtcagatttactttgcaatgtccatcttaatatttatgtttttaatatttttaaaataaattttaaggcaatagcatgaatagatgaatacataagataataaatgaaactctagctctttataacttaaaagagggtaggataaagaggcatggcataattttacattttaacttcagtagatgacaatatttgggaaaactaaggaaatatggaaggttagacaaaaataccgattcagggctagaaacaatatttatattttacaatgcccattttagggaaacacggcattgctatgtttttaaagcacgctttagagagtgaaagagttcactttagaaagtacaatttagaaggacttcactttctaaagtatgccttagaaacacagcaatgctatgtttttctaaaatgaagagaaagaaactttatcactctcaaacagcaaggcttaaaatttgtagagaatgtgaatgaggaaaagaaagacaattgttcaggaagttcaataaatcatatttgctgagtcattgagttattaaattcagcaaatatgattcactttgtggcataagtaacagggaaacatgttccatcacaatttcaagatgaaatataaaaagcttcagtctctcttttgtctctctctcacacacacatacacacacacacacacacactcacacacatacacatatgcacaaggtaattgaggctagggaggtgaaagaaatgtagagtagggtctctgacaaatgtggtgaagggtctctgtgtacataatgattttttgaacaatctgaagacaattaagcaaattcagaataattttaacatttcagcagattaactggtattaaaaggggaaaagattggcagaagctttattctaatcatgcaccagaacaacaacaacaacaaaaacacacacaaaaaatcaaagtggcaaatggtttcattgattattgtgaactatccggcacccacgagaaaacaataatccaaatttgttagctcctcaaccttggatgagttttcatgagtattttataaattagtgctataatggcaggagacaacgaactcccagaccacttccaaatttaaaattatatagttttccattgaatagtttattattttcttaataaagataactgtttcttaataaaactaatgctatataaagacaaagtggataaaaaatcattagcaagagaattagtaaacaatgcatagcaacatacatgcatatgagcatatatatacacccatatatgcatatacactagacctatatgcacataattgtaattatatattagtataacaataaaaatcctaaaatatctcaaatgtggaaataaaaatgctgagccaacactagcctagagggctgagaggccagaagagattttgagtttcaccatctgttggatcattcaagcatttcacaacttcctgccagtatcaaatctccgctattttatttgttccaagaaattttaaaacaaatgagagaggtaaaagcagttgaaaatgctgaaagttttgttcactttaaggggttattgttgaggcaatattgctcattaaaggaattttaatggcttaaaaattaaagcttttcaaagtcaagtactttatccctttggaagttttagcaatttaaacttgaataattttcatgaccaaagtaactgcaaaactataattttatattacaattgtatttgtaccatctgacctaattattaaatgtttaaacataataaacactaatgaagtgctctgtcactacaaataagcttctggtcagggtgctattgtcattctactttcttcttgtagttttgttacttttctcgtgcttgtccacagaaattcccaccaagagtcaaagttccacttgcatactcctgtgtgtggaacaagggtttgggatcaaagagtctgccttttcattctgggctctgctacttattacctcttccttgaatctatatttttaatctagagtttctaatagttgtgatgaggatcagatgagatataaggcagaattgcatttgtcaaatggctaatatatgatatgtataagatatgctaagtactcagtaaatggtaattgtttttgctatttctgatttgggcttggattttaatttattttttattgaatgttggataggtatttacccattcacacaatgttgtctaaatgttcatcatactttctaaagttaagggataaagtacgctgaaaggtagctattacctaaaataataactatacctcaggcgagataatacatattatgaattgagaataaacacgcattaaataagtggtaaagcgatacaaattgagtttatacagtagaaaatagaagggggttatttctattggcagccataaggctagagtatgttgggcataattcttctttaccagatacaatgttttgtatagaagtatactcagtagattttttaattctgtgtttctggaactaaacagaaatgtgtggaaattgtagaattgggcaagaaatggaattagaagattcaagagttaatccaacggatgtgcatagattgaagaaataagtccaagaaaataataaatggattagaattttgcaatctctagtactcatagttttttaaaagcaatattaatcaatgaaatacatatatgtgcatccattctatgccaagaacatcacagttaccttggtacttgagacacggagacaaataagacactgtctatctctataaaaacatcatagactttcattctagtgagagagaaaaacacacataaactaggaatgacaaaataagacacatacaaataacaacgtgtgaagcatttcatatttacaaaataaacataaaatactgttcattttctgaaaaactttctccatttatcttgaaatatgtagtatttctgtcaaattttataatctattattaggtatagaaacataaatacagagataagtttttcaataataaaaatattcccagtggaaaatggcgatggatacttagtcttaatgtcagtggcatcacagggattggtacagacactggtgaactaaaaatatcacacggtttaaaggcagtggactatacttggaaattgttgctgtagacaacagcaggctcagcattaccaaattatctcatttttttgagtagaaataaattttgatattttaatgtgcaaagcctttaaaaatgtgttcaattcaaaaaagtggctaagaaaaaaattaaaaataaagtttaaaaaaccctcaaaactatatctgtgggtggaatcaacattcaggtttctgctgtttgatcctgaactcaaggacttataaaagggaggcatgaagaagagctctgcaaaaactatagaaaattggaagatacagaaagaacactgaagaaaaagctactgtccttagattttctatggaaaattaggtcaggtataaagaacatattcctaatcagatgaggaacttttaaatcagtgaaatcatagaactgcttctttggaggccttaatttttcatctgtttggggttatttaaatgaagccattgcaagtgtgtcctattttttcaaagtatattttgtggactccccaactgtaatcacaggatgtgcttgttaaaatgcagattcccagacacctttccagatacagaatcaaatatttttggttgggtacagaattctgatttttttaaaaaattaactctagttaactttgatacaaagtacatgttgagaattataccactggactcacagccaccaaagacacttgtttagttggcgactttgagacccagtcagacttatgagtacctcggaactggaacccaagagacgtatttataacaagtttaactaggtgacattaatgtgtcttcagctacatggaggctatattttattgcattatatattcttccttcttgttactaatttctttggatgcccgcttttacaataaaattaataatttagaagcttataacttctttgtaaaatggcatttctagcccaaatacttgtttaaattcagcataaaaaagaaaacctagttcataagtgatatgtcattaaggatcactgttgtttatcatgaatttcattgtatctttaaaaacatgacgtttttatttttattttttaatttttatttatttatttttttaagtagagactggatttcaccatgttggccagcctgtctcgaactcctgacctcagatgatccaccagccttggcctcccaaatgctgggattacaggcatgagccactgcacctggcctaaaaatatgactatttggtaaacatcaccagggtcctaagaatattgtgtagattatttccagtgggatggtagccattgagcaaccaactgatcaaattttaagatcttgtaagatcttgtaagatgtaaaatgtagcactttcgtaattacctaacttatttgtgaatctgcttttgaataatagtaaaattgtgttttcaaagccatcttactcagaagtaaattatgttaatatacaataaagagaacatacacttttactatatgtatatggaaaattactatatcataaggtcttctatacagctaaaatttttgtgacctgggtacctggacttcaattgagtgagaaaatgaaactaagaaagttacagcattgatgaatagcatagtatatactatattaacagtcattactatatattaaaaagtagcttaaaagaaaagaaaaggccaggcacggtggctcatgcctgtaattcgaggtgggaggatcacaaggtcaggagttcaagaccaacctggccaagatggtgaaaccccaactctaaaaatacaaaaaaaaaaaaaaaaaaaaattagtcaggcatagtggcgggcacctataatctcagctacttgggaggctgaggcagagaatttcttgaacccgggaggcagagatcgcactgagctgagatcgccactgcagtccatcctgggagacagagtgagactccatttcaaaaaaaaaaaaaaagaagaagagtaagagtaagaataggagaaagaggaggatatagaatggaataagagtcacagaatgagagtattcagcccaactgtaactttgttttcaagatatattagaagcctggggaattcttctataaattctacttcccatttagcatgttctaaagttcttctgtcatgtcagtataatatgagaagaggtaatgtattttgatacctcctgttttctatagacaaagtatgtagattaagtacatgagtatttgaggttcaaatgcacctattaaaatgacagtataagtatctatttaactggagcaataaacatacatatctttcctaaagtgatacttaggttattacaaatgccctattaggtttagttatcttcctcatttaaaacactttccacatacagatagtagtagactactaaccttatgctggaacatacattatgatgtaaaaccggggaaatatttcaggtaaactcattctcagcagtggtacatgattatgaagctgtgttttatcaacatgattgctgtgagcaccaaataagaacatgcaagtagcttggttagcataatgtatagcacagagtaagaatataacaaatgtgagttactaggattgtaaagattatcattattattgtttgaatagtaatctctgtatgtaaatagacatacatattctactaacagatttgtgttatctacttgagtgtgtgtatatatgcgtgtgtggctatgtgggcaccagtggagcaataatgagtttgctacatgttatatatttctagaatcactaattatgttgaaatattattacaaaagtatgtgccttaacaaactaataaatactttggtgtctaaataagctcaccatagagcaaaatatatgaagacacacagagatagctatatatagagacaacggcagcatgttattccatatggaaaaaaaaatttgtatctgcagataaaatggcactccaggaggatatcaaagcatcaaatggatgttttcattaaaagaaaatttgtacatgaatttttaaaatttcagttcatgatgttactcattagctctatttttaacaaaatgttcccttttgcatagagaaaggaaagtcaaacactgatcttcaatattaatagttaagaacctgaaaacatcttacattttattttataggtttaatctaacttaaaaaaaatgttaaataaaagacaatgaaattgaagacccctcctggagaaactagtgaggatactaatatagactctacctcctcaaaaacctaacttcaaagagattttaaagaagtcatcaattctctcacatggcagactgggataacatctgttaatagagacttaaaaaaagtaagtaatttaaggaagaagggttgataattcattgattgggataagagaggaaatggcaagagaaacaggtatggtttcataatgacattgagataagtctcaaaggctgaaggaagaatttaatataattattacatctagtgatactgatgagaaacacatcctttctccctcagttttctttttgtgcgtaatcttgtaacagattgttcatgttttcagtaaatactgggagtgaggaatggtggaatgcagagatgttaagcagagggatttggtcccaccaaaggtactctaaattaaataagatgtgctcactttgcaaaagtgacttcaagataagtgcctagcttccaccattactgctatactccacttctaacaaaattatcatctttaattttctagactgccgcactagaaccatcatagtgtggaccaaatttacactatttttctacttcctatttctattcttctaaagttcttaatctgtgttctaaatctgggactgggcttctaagagtaggttcactgattgtgttatccaagacaggggttggcaaattatagctcaccggacaaatccaacccacacctgatttttgtaaggctgaaagggtaagaatggttttgacatttttaaacagttggggaaaaaatcaaaaaaacagatatttcttaacatgggaaaattatataaaatttaaatgtccacaatcttgttccccttttaaagatatattgttgattattttaacactacaacaaccagagttaaatcgttgcagcagagatgacgcggcccacaaaagccctaaagatttactttgttctttacagaaaaagtttgctgacccccaactcaataacttattttatataaacataaatttttcaggaaaataatactgtgaacccataatatgattgtagcataatgggaaaattaggcaaagattgataaaataccaatcttattattatacagtcacatatcatataggaaaaatctgatacaatggatttaatatatcagatgggaatttgagataaaaaagattctaatatttctagtcttataaatgaaactgagcctaaatgaagctttcaggggaaatgatcatgtaagacaaattacaggggttggtttctaaaaccgattctttttactctttactgaaggtcaaggatactgaatgtgccagtgcaccttcagaaagcagcctgcatcagcacatttaaaccactgaatggtctcaccacctagtttcttgcgaaagctgagcaatacattttgtgatagataccactgagaaagttaggcagaaattgttattagtagtatatgacaatcataatagtctaacttttactgtaaaactctattatttatatgttttctgtacatcctgtaggattgtctgtattttgcaatagaattgcaatgtgtaagagaaaaagaggcagtctatgtttccattgtcattctaagggacatattatccatacaacacctcctttttcccctttactgaaaagctgtgtataaaacactctaccatgctttcctgaaacataaaagaagatttattactattttaataaagaagtaagaacaaaaatatccaatctcctaatattcaatggagaagaatatatattcttttttaggaggacacaaaaatagcaagcttaagtatattctgttccctaaggtactgtgtaggtggagaaaattatttttcatttaaaattatatacttgtagttcattttaagtaagcccagtggacataaagctgattcattcacaaatgcaaaattttgttgtaattatttgcttaaccaaagcaatattcatcaaaaatggattaatgctaggattattttatttcaagtaaatgaacatatattgattagtgaccttccaaaccccatgctagcaacagtaattactattattaataaaatacatcctctagtgcatattaaatggttcaatttattaaatatgctgatctctgcatacctcctcaagattattttttaagaaaagtttactttgcctgagaaagaaaagatgaaatatgcaaacactaagtttactaaaaccaccaaatacaagctgccttggagtcccgttgttctgaattgtcttaccctcttaaaatcagatgttttaagcagataactcaatttttcatacaatataaaatgtccaaaatccgtgtaattctctgcctctgaatacatagtctctatctatttttctcattgttttaatctaaaaggaacattatgttttctctttttaaaagtaccctccttcagcattgtttttacttctaaactccttagattttctcctcaaatcccatttttctccgcacaatctcatcctcctttagctagaatcactcactggtgattaaacagagtcacgcagaaaataatgaatgcaaaaatgtgggcaggaagaaagataagggaagaaatattcttcaggaaagaaaatgaaacggtatttgtcagcgatgttgtaaaggggaagaaacattagagaaagggtgattggttgatagtgtcaaacgctgtaaagaaaggaaagaagaggtattttttaaattagcaaagtggagaatcatttttaaactttgagttagagttattactgaggaatgagaatttaagtttcctttgtggttttctgtgcttactaaatcaccagctcttcttataaggtgagtgatatatagtaagaatgagagtctgtggggaaggctggtgaacatactttgatgaaaaaatggactgtaaaggagtaccatccctgtcataggaagagatattttagtgtctgaatctgtgagggggtgtgtggaggtcaatgttgatgctctatgtatctaccggaggaaatttatgtgtgtgtgtgtgtttatctattgtaaggggaagccgtgagatatcagacttccctggcttttcctatctctgataagaaacactgtagttctagggaagctgagcgctggaaaggaccttgactttgataaatacaataattggtgacaagatttaaattttgttttccatgagttctggtgatagggcattctggcttgttttatgtcatttgtcctaatcctcttaacctcttaacctattctacaaaccactttaaatatttcttctcattattccaaacccttgctgtcaaacatcattgtaacctgtgtgtatatatatatataatatatataatatataatatatataattatatataatatatataatatatattatataattatatatatactatataatatatattatatataatatatattatataatatatattttctatatattatatataatatatattatataattatatatatattatatataattatattatatatatatttttcccactacagtgggaaaaaccattaatccagtggctatttcctgtacactatctctcgtgtctgtgagctcctttctgtttctattgccatcagtgtctttcacaacctcctctttctttatgatgtgtttcaaagcagattctttattttcattctcccaagacctgctgcaccttgcctactaatgtcagatacgttttcttcaaatgtcacacttcaggttagttatttgattgaatgcctatgtgattcccactacttccatataaagtccaatccaatcaacttaattattcacagttttgttcaattgattttactttccctgcctgactttccatttgtctattcaaggtagactagtttccaccattgcgctgacttcttgccctgaaatcactacttacagccttactcatcaaagcaaacgacatcaattaatgaagtaaaactcttgtcctaggctgtctattggtcttctctgatcctttggcggcagaagctctgcatacatccatcttgcctagacagtgttatgcaaattaacacaaccaaaaacaaaagtcaaattgtggttccttttatatattttataagtactattattaataatgaaaagacttttttttaaaatttgactaacttttttacataatactatctacttcataacatgaaaggattaagtggatttttataaataatgtgcatagaaccatgctgagaaaaatatgaatgttctaacattggtactgattgttattgttatttttactgctaattcttaattagtagagacaaatgttgactgaactatttctttggcgagaaataaataatgccatattttgggctcttcaagccgagtctcttctggcttggaacactaaactatataaattgacccttattatttaaaatgtaaaccacattaaaaattcattttcttaatcaagatgaagctaagatatttggtttccaaaccattaaaatttttatgagcaattctctgtaaaagcatttacctctggtatagtcgactactagttatgtactaataactattactaggatccattagctactcgctttgatctgtgttgtcatgaacaggaagatttggaaactgttgatggtttatacattgactatacaaaatactatattttaaaatgaaatcatatgaaattaatttatcaagattaactgtagtgattacaaggaaagaacagagagtacatgtttgatacattaaaaaatcttttcaaaaaccaaagaaaatcatgggtttagattataaagtcataaggtgataaggcaacttttgctcatgcggaaatatgttaattagttttataatattgtttctccatcgaagtacttatacacgtgtttggctacttaaaatagggtaaagaaataaataaataaattataatgctctaaatgaaatttggcatataccatctctcaaatttgcagtttatagtgcaggaacaaaaaagaaaagggaagtgtgatgaaaatatttagaaccacttgtctagagtttaaaagaattagtagcaaaaatattacaaaatataaaactactgattgccttgaatttgttacctgatcccaagttatgaacattaaaagtgtcataaagaaacaaagtcagacacttgttaaaaatagcaagacagatcttagtaagatactgcagtagggaagagagacttcagtggaaactgggttcagctctgatgaaacaaaaggcagaaggctgtttaaatgctggaatatgctaaagtaggggttcccaatccctgggccatggaccagtatgggtctgtggcccgttaggaactgggctgcatagcaggaggcgaatggtgagtgagcaagtctaagtaacactttgtatttacagtggctccccatcactggcattattgcctgagctctacctcctgtcagataagccacagtattagattctcatagtagtgcaaaccttattgtgaactgtgcatatgaggggtctaggttgcgtgctcctaatgagaatctaatgcctggtgatctgtcaatgttcccatcacccaggtgggattgtctagttgcaggaaaacaagctcaggactcccattgattctacattatggtgagttatataattatttcattacatattacaatgtgataataaagtacacaatacacgtaatgcacttgaattgtcctaaaatcatccccccaccccactgggtccgtagaaaaattgtcttcagtgaaactggtccctggtgccaaaaagactggggaccactgtgctaaagcaaaagtaccaaagcactttgaggtggatgcttaatgtgattagcccagttgtgtttgctaactggcacttacagaaataaagtccctactttaccacagagactgggaaatagaggccctatctttctcaatggttacatttcaaaaggaggtctcccaggtccttgagaaagacattcctgagttgcagatacatttcacaacgacaaggaaaggactacaagtttcctaatgtaaattctctaagaaaagggaagtctgggacccatagccaatgatatggtttggttctgtgtccccacccaaatctcatcttgtagcttccataattcccatgtgttgtgggagggacccagtgggagatgactgagttatgagggggagacttttcctgctgttctcatgatggtgaatgggtctcctgagatctgatggttttaaaaatgggagtttgcctgcacaagctctctctttgcctgctgccatccatgtaagatgtcacttgctcctccttgccttccaccatgattgtgaggcttccccagccacatggaactgcgagttctctattaaacttttttcctttgtaaattgctcagtctcaggtatgtctttatcagcagcttgaaaacagactaatacagtaaattggtaccagtagagtgaagctttgctgaaaagatacctgaaaatgtggaaacaactttggaactggctaacaggcagaggttggaacagtttagagggctcagaagaagagaggaaaatgtaggaaattttggaactccctagagacttgttgaatagctttgacaaaaatgctgatagtgatatgaacaataacatccaggctgaggtggtctcagttggagatgaggaacttgttggaaactggagcaaaggtgacttctgttatgttttagcaaagagactggcagcattttgcccctgccttagagatttgtggaactttgaacttgagagagatgatttagggatatgtggcaaaataaatttctaagcagcaaagcatttaagaggtgatttgggtgctgttaaaggcattcagctttacaaaggaggcagaacatgaatattcagaaattttgcagcctaatgatgtgatagaaaagaaaatcccattttctgagaagaaattcaagcgggcggcagaaatttgcagtagtaacaaggaacacaataggggaaatgtctccagggcctgtcagaggtcttcacagcaggcccttataccacaggcctggaagactaggagaaaatggtttcatgggcagggctcaaagtccccctgctgtgtgcagccagggacctgatgccctgcttccaagccactccagccatgggtgaaaggggccaatttagagcttgagctgtggcttcagagggtgcaggccctgagccttggcagtttccacgtggtgttgagcctgcaagtgtacagaagtcaagaattgagttttgggaacctctgcctagatttcagaaaatatatggaaatgcctggatgtccaggcagaagtttgctgcaggggcctggccctcatggagaacctctcctagggcagtgcagaagggaaatgtggggttgaagtccctacacagagtccctattggggcactgcctagtagagctgtgagaaaagggccactgtcctccagaccccagaatggtagatccactgacagcttgcacagttcacctggaaaagctgcagacactcaataccagcccatgaaagcagctgggaatgagactgtagcctgcaaagccacagggatggagcttcccaagaccatgggaactcacctcttccatcagtgtgacctggatgtgagacatggatttaaaggagatgattttggagctttaaggtttgactgccccctggatttccaacttacatggggcctgtagcccctttgcttcggcaaatttctcccatttggaatggctgtattttcccaacgactgtatctgcattgtatctaggaagtaagtaacttgcttttgattttacaggctcataggcagaaggcccttgccttgtctaggataagactctggactgtggacttttgagttaatgctgaaatgagactctgggggactctcgggaaggcatatttggttttgaaatgtggaaatatgagatttgggaagtggaatggtatgatttggctgtgtccccacccaaatctcatcttgaagctcccatagttcccacgtgttttgggagggagctggtgggagatgattgaatcatgggggcagatctttcccgtactgttctcatgatagtgaatgggtctcacgagatctgatggttttaaaaatggaagtttgcctgcacaaactctctctttgcctgctgccatccacataagatgtgacgtgctcctccttgccttccaccacaattatgagacttcctcagccatgtggaactgtgagttttccattaaacttctttcgtttgttaattgtccagtcttgggtatgtctttatcagcagtgtgaaaatggactaatacagccaggttttggcagaaacaaacattaacttattttagcaatgttgatgtttgtcaggtagacatttaagtgggctgggattgttaacctgggacacagccttgaactgttaaaaagctgtgctagaatttgttcaagtctcttagtgtgggacatgcacaaaatcatttatgctgagaatctgcagttctcacaggccaaggttaagtcccagtcaataaaaatgctcggaggagcctgactaaagtctggtcaaggagagagtctttgccataagaaacttaataataactaatatctctaggctactatttgtcatgcaatgagctagtatttgcagctttttcttatttaattctcatatttcctcttgaggaatatactaggattactgcctttatttgaaatgtgtaacaggctaagtaattttttcatgaattaatgctgtcctcatttatttaaactgtattttcataagttagcactagatacaggaaccaagggaacaggtgtagaagtcccaagaaactgaatgtgtgggcaaagcaaagaatggctaaacacacaacatccactgagttaccatgcacgagaagaagcaggaagatgtaggtcccctgttggccttatattcttcccacataaattatagattaacatatttcctgattttttgaagtttccagagatttaccaacttgatctttcatgtgactttctcttattctggattttcagtgacttttcctctcactttattgtctctaaaatcacagaaaccctgtttaccacaattattttcttaaatttatttctacaggtctttagttaaaaggtacagggaagcagacaaaccttaaacttgataatacgtgggaaataatgttactggtatcttagaagtcatgccagtaattcgtctaaatttaagcatcaattgaaatacggatgcaaaattattatacgtgattaattactttaggtctttcatcagtttatggtagagtaaccaaattgcccttgatgcctctcatgtgtcaagtattgttttgggtgcaaaggatagatcaataatatgacatggttcttgagtcagtttggttatgactggagttggtgagaatgttagactcacattcatgagtggatttgataaatacaatgtggctgacatgatgtctgctctcaccaagacttccatttcagttctttgatttctcctttgctttcgttaggaatggcctatatttggtacaccaaaaatttacactaattagtgagcacttctcctactttaaaagagaagctcaaacaggaaagaatacacacacacacacaatttttttggtatgagattcaaaattcctagaaagcttatgacaaaattatcaaatttgttgaattctcaaaattgctaaatttctgaataatgttcatctagctacagtacttattattccaccggaagaaagcatatgcttcaacacaaaaaaaaaatttgagtgcaaaactattaagtaaaactctgagaaaacatcatttttgtacttggcaataaggcaattacttaaaaaaagttagctaatatttgtgagtgttacatttaattaaacattaaagaactttatagaagtatttttaaaaaggaagaaaggaagaaatgtaataacccagaattcaagagaagataagcaaaatgttatttgacagaatccagaagcacatgaaaaagttaattcaccatgatcaagaaggctatattcctgggaagcaaagttggttcaacatacgcaaatcaataaatttgattcacctcatacacaaaacaaaactgaataaccatatcattatttcaacagactcagataaatcttttcataaaattcgacatctctttatgataaaaacctacaacaaactaggcattaaacatacctcaaaatgataggaaccatgtgtgacaaacctagagcaaaatcatactgaatggacaaaatctggaagcataccccttgggaactggagcaagacaataatgcccactttcaccattcctattcaacatagtactggaagtcctagacagagcaatcaggcaaaagaaaaaaatacaaggcatctaaataggaaaaaaggcagtcaaattaactctctttggtgctgatataattctgtacctagaaaactgtaaagactctttgaaaaggcccctagaattgattagcaactgcagtaaagtttcaggatccaaaatccacatacaaaaatcagtagcatttctatacaccaataatgttcaagttgggagccaaattaagatcaaaaacccatttacaatagccacaaaaaaaattaagtaggaatgcatccaacaaaggagatgaaagatttctagaaggagaattacaaaatactgctgaatgaaatcatagatgaaacaaatgggaaaatgttccatgctcatgaactggatctaccgactacgtttttcccagaactagaagaaagtcttctaaaattcatatggaactagaaaagagcttgaatagctaaagcaatactaagtgaagagaagaaagctggaggcatcacattacctgttttcaaattgtatataaggctactttaactaaaacagcatggtattgtcacaaaaacaaacacatagaacaatgaaacagaatagaaaacagaaataaggctgcttacttacaaccatttgatcttcaacagactcgacaaaaattagcaatggagaaaggactttctattcaataaatggtgctagtttaactggctagccatatgcagaagaatgaaactgcacccttgcctttcatcgcaggcaaaaattgtcttaagatgaatataagacctaaaactataaaagtgctagaagaaaacctaggacatggcattctggacatcagccttggctaagaatttatgagtaagtcctcaaaagtaattgcaaaaacaaaaattacaaaaaataaaaattgacagttgggaccctaaagagcttctgtacctcaaaataaactatcaacagagtaaacagataacctatggaatggaaggaaatattcataaattatgcaacttacagaagtctaatatccggagcctctaaggaacttaaacaattcaaaagtgaaaaaacaaataagctcattgaaaagtgagcagaggacatgaagagacagttctcaaaggaagacttacaagcagccaacaaacaaatgacaaaccctctacatcactaagtatcagagaaatacaaatcaaagcaaatatgagatactgtctcacaccaatcggaatgctattattaaaaagtcaaaaaataacagatgttgatgatatactttgaatatatgtccctacaatatctcatgtaaaattgtaatccccgatgttggaggtgggacctgcttggaggtgtgtttgggttatggaggctgattcctcatggcttggtgctgtcctcatgacagtgagtgagttctcatgagatctgatcatttatcatttaaaatgtgtggcacttccccacctctctcttgcttccactctgccacgtgagagccttgctccagctttacctttcacctgaggcctccctagaagctgagtagatgctggtgctgtgcttcctgtacagcctgcagaacaattagccaattcaatctcttttttaaaaaaattacccaatgtcaggtatttatttatagtaatacaagaacagcctaacacagttgctgaggctgtggagaaaagggaatggttatacactctaggtttgaatgtaaattagttcagcctctgtggaaagcagtttggagatttcccaaagaactcagaactaccgttagacccagcatttacgtgactagggatacacactaaggaaaataaatcatcctacaaaaaagggacacattactttgtgtgttccatcatagcactatgcacaaaagccaagtgtattagtctgttttcacactgctataaagtactgcctgagactgggtaatttataaatgaaaaaggtttaattaactcacaattcagcatagctggggaggcttcaggaaacttacaattatggtagaagacaaatgggaagcgaggcacctttttcataaggaggcaggaaggagaatgaactcaggaggaaccaccatacacttataaaaccatcaggtctcatgagaactcacacacttcgcgagaacagcataggggaaaccgcccccgtgattcaactaccttcacctggtctctcccttgacacgtggggattaaaaggattacaattcaaaatgagattttggatggggacacagccaaaccttatcatcaagacatggaatcaacctaagtgtccatagattggataaagaaaatgtagtacatatacaccatggaatactacacagccataaaacaagaatgaaatcatgtcccttacagcaacatggatgcagctggagaccattatcctaagaaaattaacacaggaagagaaaaaccaaatactacatgttctcacttataagtgggagttaattattgggtacacatggacataaatatgggaacactagcactgggaactactacagagggaagagtaggagtgggtcaaggtctgaaaaaatacctgctaggtactatgctcactatctaagtgatgggatcaatcataccccaaaactcagtgtcacacaatataccatgcacatgtgccccctgaatctaaaataacagttgaaagcataaaacataaaataaaataaatcttcgattggcatgataaatgttaaaaattaaacatcaagggaaactgtgtgagaaacatatggggatactctgtattaccttggcaacatttcagcaaatttaaatttatttcaaaataaaaattcatattaaaattacccctgctaaaattttaattaacaatatttataactttaaaaaggaaattaaatgtgtttcaagaataaggggacactgacatcctccttcttccattctgaagaagatcataaaacataagcacctgcacctgccccaagactggatcaaaaggtgaacacacagatctattaatcactcatctaaaattctcaaacgctaagatattccatagactctaaagtcagacctgaatactacctcaaaggacttgaacaagaagttccaagaaaaaaatagcaacagtagttttaggaggaaatgtgcataattaataggtcaacaaggataggtaagagacagatagcctgaattcccactaatgggaatattaaaaagaaacaatgaaagaaaagtatatacttacctgtacaaatgaaattgtaaactaaagagaattccagtttagcagattaaagctgaagtcttgactcaaatttccatttggtctaaaaccataatggaatacggagactgaaaaaaagcccaagtaaatgagacacatttctgtggaaggagttaaatgattttatttttttcaacagagtaacctgaagaagggagcctgcataatcctgaaggtcagggagcaaattaaagagtaaaggggcatccactggagattttcttctgaatgccttgggttttaagcatatccttttgtgagatgcaagggatgttgggttgtaggcagagctagaaatctttcccttcttattttctagttcttttcagaagttgccctaatcatttagaaaggagatttgcatgaacctgaaagttgcagagtttgctttgtaaagaataagaaacactagtgtcaaagatcaaataaagaaggctggttgctttacccgttattcaggcagagaaggaaaatagtgaactgtgtggaccatgtctaggttcaaggaggagacaggtgaaagcccagagtacctaacagtggagaatttctggacactggaggaaaaaaggtttgatgtgaagaagattcaaaaagtaaaatgaaaaagaaacagtgtaaatatgtcctccccacacaaacactggctcactgagggaaatgggagtcttcgtaatctccaaggtttcagaaaatataaagtatctacctgtaaatcaattacgccccaacccaatgctaatgaatgtactttctatggagagatctctctgcaataaccatggagaactgaaaaactaaacctaaatcataagaagagtttaggcacatattaggagtgttttagagaaaatgtcttctgacagcatggttgtacacaaatcagccagaacttttcatgaccccatgcattagctgatatgccaagatgcccatgcaccagccatgaatctccttctggccactggagccaatccttatcttcataaataccttccattactttcaggtttcttgtgtccatagccaaatgactgaattaaactctgaaaaacttgtattaggagcaaccttgattcttaccaaaaacaatactgcatttcaagaagatgaaactttttatatggtaaattataaaatcttgcactgctttctatacttgtatcaggagcacccttgattcttaccaaaaacaatactgcatttcaagaggatgaaactttttataaggtaaattataaaatattgcactgctttctatacttataaatattttgcatatgtcattatagcaaataacaatttttagaaataattaaagtctcaaagtgttcctttcttgaagtcagcagcagttacaatttgttgtaactagaaaaactgaataatattttattcattttaattattggaggtcatataagtctctggacttactgtattttatctaaaacatgtattttcattttggaaatggagaattatttctttattaatctaagcatgtctatgcttttagaatatgaggcaggctctgcaattttcttacaagacgctaaaggaatggaaagcaaaatcaacaaaaggaaaagagactgagaaaaaaattatacatattgtttataagtttggtgataacaagagttacttttaaagatgcttgcgcgtatacactatcttccaactgtttcagatgtaaatatattaaaacaagcattttaacctcagataaataaaaaagacacatagttaggcatcttcacaattataaactgctgcttattcttatccatgctcctaaaatgccttataatatctgctgtcactgccttggattataagcccaaaacagaattttctttttttaatagataatattataaaggtgattttctaagtgtacacggcctctttaggaagatagcagtaaggctcagatgtatgatttatagagcagagcttttaagccataaactcatcattgatgtcttacagccagatttaattaccttcctgaattttgattattttttccttgctttaaacagatcacacataaaagtatgcctacgtgatatatagtttttcttgtttttgaaatgtatacaaatagtctcctataaataaataaataaataaataaataaataatttattcattcctggacttgctttcttgactcagtcaagtcaaagctaaaatgaaagcaattattttagagacctatgtaaaatacatgcttatttagctgagatttgcttcaaaaactcgagtaaaacaaagagctccatgtaaaaatggtgacattcgtgtttaattttccttaattcatctcatatatgtatatatatatatgcacacacataatttcatacactgtgtaattttacaatctgtactgtcaccaaaatttacctattttatcttgtattctaccagagttctattacatggaaattgtgaagttcacagtaatataactactctaagttgttaatcacatataatacattaagcattgtgttgggtaattggcattcttttatctcttttaatttaatgaaaattgtattagttaggataggcaataatgtgttatggtaacaaatataaaacatcagaagcctaaaataagaaaaattatatattgttattcactctcaatgtccaaattgttctgctattatactcactcaaggatgtaggttgacagagctaataatgacacactcaaaagagggaagaaaaacatcataaatgatacactggatcttatatttatcattcagaggtgacctccacgagttcacttttaatcacaaatattatggtcatatatcacttgaaaaacaaaaacacagaagtataatcctgtcatgtgtctgcaaagaaaacgagaaatatttggtaacaggaataatgactaacctctctcaaaaaaaaattacaagacagccactatcatcatttgtgaagtaaagaaacagaagctcaaaaaagtaagtaacgttaataattgacatgaagtcattaatccagtaatactaaaaactgaatactaatccatttctaaaacctttattttttcctagtattaatattttaattggaacttaaaggtaaaacattagactaatcatcaacagtttatgatgcaccatcaccattagcaaataaatggcgcttttcttaatggtatttatttgtacagtgcaatgaatattaaaaatttgcttaaaccaagaattagagtattaccaactatattcatctgcatgtctctattctcccattcccctgtctctttaccctcagagataatcactttcccataggccagacaagagccaatcttgtaagcagatgtttctaagtgcagcagtctcaggtctcttttctgcatactgtaaaactaaattgtatttaatttgcatatatcacattttccttcctaatatgaatttataaatgtcatgaatgatgttgacaaaccatgaaacaatttcatataaatacattttctagaagccacatataatagcaaatgaagtggatttaagattttaggttaggtctctgaaatgtacaaacagaaagaaggggaaagagcagaattgaaagaagaacatgggcaggaggtcacgtcaccagcatagcattcccagtcagctttctagagctaatgactgatatgacagaagaggcaaacaatcccaaatctataaaatataacattgttaaattctttatttttataacttataaataagaacattaatttccaatataccattgccctattattttccagtactagaaaacacaacaaaattttcaaatgatttacacaacgtcatatcaaggcaaactatagccatattgagacatactcatgatgtaatataagtaaacaagatgtcagtaagttgtgattctcccaagtatataaaagcctttcaaacttttatggcatagcgtaccttctttccttttttgagctaaaattttctactctgtatcactatatctattcctctgtctgtcctactcctagtcaagactcaactaagaatcaatcttcaaaaaaaaaaaaaaaacaattcagggaggctagctgaagaatgatttagttacctattttgagctcccatcatcttcttggaacactattttgatagatatatgagttttcttgtcagtatccctcactatgctgtaaaatctataagagaggtgttagttttctatcactatggtaacaatcaccacagacttaaaataacactaatttgttaccttatagttctgtgagtcatcagtctcattagcctaaaatcgaggtgtggacaggactatatcccttctgtaggtcaaaaggaaaatccatttatttgtctgctccggcttctggagacagccctgttccttgactcatggttcttcttcaattttatcagttaataacagttaattgagtaccactcacaacacgcacttattccatagtcacatttccctcagactttgagcttatctgctttactctttcattttcaaggactctaattattgtattgagctttcctgtatattccaaaataatcttttcaggtcagctgactggtgaattttatcttcaataaattctcatttgctatgtaatgtaacatatttgcgagttccagaaattaggacatagaaataattggggagttattattctgtttatcccaaggggcataaaaattatccagtgtttttaatgagctcaataaatatggtatttatcaatctgaaacaatcaagtttcagaacatgtctgaatctatttggtactgtggacagcatgagcaatattaaatgttagaacatctgaaacagatgaagaccttttatgtggacaatactcagatctacttgactaattagtacagtctcttaaaataattcctttagattaattccttcagataacagatgaggaaattgtatcccagacagacaccgtgattttctctatgtccttcatggaaacagggagactccccctccaccctgtgtcacattttgtaactcgcacaacataaaagatctgcttgaaccctgatgactgatggtctcatgaaaaaaaagatctttattttcagctttttgtaactatgtattttagacatatacattatgagactggattggggtaccaatctcagagagaaagtatgtattttacctttacatttttttatttgattacaatctagtaaacaagttaaagaaagaaacccatggcctcccaaataattgacagacatttacaattaagattattctttcaaaattcaagttttgaatttgaggtaagaaatatcccttcagaaatctcccacatttttgctgtatctacagtatatctcattatactcagttaagtcattcagtaataactaaaatcctaaagtacttcgccaaaaatttaaccagataaaaacaattttaaaaagtagctaatgaatttaagatagtgcctggcttccattttttacacttgtcaactagcctatcttttattatttaatttttatttatttctcaaagaactaaagtagatctaccatttgatccagcaattccactactaggtatctactcaaagaaaaagaaatcattatataaaaaagacacatacacatgcgcatttatttgcaacacaattcacgactgcaaagatatggaatcaatctaagtgtccaccaaccaatgagcggataaagaaaacatggtatatagacaccacggaacaccgctcagctataaaaaataacgaaattatgtttttttttgcagcaacttggatggaactggaggccattattctaagtgaagtaagtcaggaatataaaactaaatacttcaagttctcacttgtaagtggaagctaaactatgggtacacaatgatatacagagtgatataataaacaatatcctaccttaacaagccactgtccctttaattttatctcctgtatcccgtaaaaaggacgtaaaattcacaggtgagtactattcttaatgtctccaaaattaatagctgtgcttgatgttttcttatagaattgaaattccaaatatatgcttataaataaacgataaatccaaatttgttacattgtacacatgttgccactttgaaagttaatattattttcaacttccaaagtttgtaataatattttaagagattcagacaaacatgacctcagaagaatctatgaggaggcatacatattctttagccctagatatataaaatcttatttggtcagagagttaagagttataaagtatttcttggagccgagtctaaatttcttcattttgttacattaaaaggcaaaaaaaaaggtctcagaagtttaagtttttgagagaaaactacattctaaaattcatgtttgaggattatttctccataatttgacttaaaatggttattttaataaattaaatacaagatactaatgccaaatgataaggcaatagaacagttacatatttgacatcactacaaagatattcaatacattgagttgtttataatagtgaataaagtagccaaaaactaataaataggagtattcctctgagagtctggtaacatatactgtaaaatccgcaaaatgtatatgggaacaccaccaaaagaaacatgattaatgttgatgattctgaggttttcaaatagattcgtgtgtatctgcagccacccaaccacacattaaccctgtcacctgaaactatcactatttaacaaaaaagactaatgaaacaatgtactttcctgatatatggcactgaataaaatatacctagtgattatagatagatttttaaaagctggtcatggtggtgcatgcctgtagtccagctgatctggaggctgaggaaggaagatcacttgagcccaggaggtcaaagctgtagtgcatcacggtcatacctgtgaatagcactgcactccagcctggcaacatagcaagaccctgtctctaaataaataaataaaaaccagttagaaaacaaaatgagaaaattgagaaaaataatttatagttaatgttgcttccatctgaatgtgtaatttgataataaagttattttgcatatttaaacataatttctttaacaggaaaacagaaataaaatcagaaaaaatgtaaaaattggaaattttctgccttcctgataatttttttttttttagaaaatcagggcaaaacatttaggaatacttactattattgcaaaaatttaatatcatgggttcaaagacacttgagatatataagtatgtacctttaatacttttctatttgttaaatatagcttagtaaaataaatgaactaataaaattcctaaatgttttactgaacaatgatttttttccttgatgtttagatgaaataatataatacctacaaaaagatactaagtgatgtcaccctgcgtagcttgaataaggacatttactgaaacatttttatgaaaaataaacatatttgattacataatttatataccttttccctccagatgtttccttttttccttccttattcttgaaattacttataaatgacaggaattttatatgagttctaaaatcagaataagaggaagagtggaagaattagaaaaagaaaaaaaaaatgccagttgtgcacttcttcacgatgcctttttaagagtcttagtgacatattaaaaagtacaaacaggccaggctcagtggctcaagcctgtaaccccagcactttgggaggctgaggtaggtggatcacttgaggtcaggagttggagaccagcctggctgacatggtgaaatctcatctctactaaaaatacaaaaattagccgagcatggtgatgtgtgcctgtaatcccagctactcaggaggctgaggcaggagaataacttgaacccaggaggcggaggttgtggtaagccgagatggtgccactgcactccagcctgggcgatagagccatttctgtctcaacaaaatgaatataataaaaattaaaatttttttaaaagtacaaacataatttagaaataaagttttgtgtgtgtgtacgtgtaaataaagcttttctaagaacatcatcataaaacaattgcatttgttttcatgaagaatccaagaaatgcacaaaataatcacttctataaatgcttatcttgaccacaatcaccacttattcagttatcttgatcacaatcaccacttattcaggaacagataagagatacaaatttttaagatctagatccagtagttattgaattaactactttctttctcaaagttttcctacaactaaactgatgatctcccttctaaatgtagcccctttaggatgtttatattagtgaatggccctattctaccttattacataccacttttcctccctttattccacttccactccccatttgcaataaatcatacacaggtacacatatgcaaacaccacacacacacacacacacacacactgctgtgtgtatctgtgtgcatgcacatttttctttatctatttttcaatctcttcacttgtctctagctccacttccacctgcttaaactactattatctctccgttggactatattgctaactgtttatttcacctctgatgttagttttcttcagtctttacacaaatccactctcttcactatagcgagtgatctgttttagaataaattgaatcatgatgttactatttctgcccccttcccctgcccccactggtcctgttccagctttaaaaactttaatggtttcacttagaatgaagactaaaattattatcattggctaacaaaccttggtctctacatacctcctcagtttcatcagcatttgatttacattggcctttattcatattgctatagtctgaatattttaactccccccacccataattcatatgttaaaatataaccccccaacgtgatggtataaggaggtgggctctttgggagataattaggtcatgagaccacagcccttatgagtgggattaatgccttataagaggccccgagagctgtctgtgccttctgtcatgtgagagcacagagaaaagaccactgtcaatgaatcaggaagtaggccatcaccaaacatcaaatttgctagcacctcgaacttagatttaccagcctccagaactatgaacaataattttttgttccttataagcagtttaaagtgttatgtttatagcaactgtctatatcaatttatagtgctatgttatagcaacctaaatggactaagacaagacacttgatctcacctcgcttacttctggtcatggaggcttatatattattccctccatttagaataaactccttgccccattatctttcatagtatctagcagatagtagagaccttaaaaaatacgttgaaagactaaataattaaatgaactgtcaccaaaagcaatgaatatatcagcatattatatgtgcattatcagctatgcaatgaattacagaaaattctgtttctcttactaaagacattatgactattccataccccaaatgatctattaggtcagtttagaggttacagtttattttacattgttttttataccttatatagttattgaaaatttattgaatataaataaaaggacaaaagttttacatttggtaataaatgcccaaaatataatttatataaaaagtatcagtctttattaaaatgactttgacccaagtttattctttataaacgtctgttgtaactctccaatgtaaagaaggcaaattggtgataaaattagttttgttttattttttgggacagaatctcgctctctgtcccaggctggagtgcaatggcacagtcttggcttcctgaaacctccgcctcctgggctcaagcgattctcctgcctcagcctcccgagtagctgggattacaggtgcctgccagcacgcccagctaatttttttgtacttttagtagagatggggtttcaccatgttggccaggctggtctcaaactcctgacctcaggtaatctgcccaccttggcctcccaaagtgctgggattacaggtgtgagccaccacacccagccataaagtttgatgaacctactctgacatatgttttttcatttattttagaagagtctcctcaaatgactttttatattaaacctgttcaaaacgatttctaaacctcaactctgaaaggatgctcaccaaatacttaaatgcacttcagaagtgaaagcaaagatatgttttcttcctacttgcatataatgaaagttaataatagaatcttattgataagtataatttgctaatacattcaaacacatgtgttgtcaaagttggtatacatatagtactgtgaaaggagagtctattttgatattttcccaggatagattatcattttgccttttgtacacacttttctgttgctctcatatgaccttaattgtttaaaaagtgttacttttttaaaaaatacatacttttgttctctgttagagcaatatgtatttggtatagattcagaaaaatatttgatatagattcagaaaaatattccatttgaaatctgggcttttaaatcacataaacatataatactagatgggtttcagttattttcttttttttttttttggcttagctctggttcattttttttaaaattttattttattattattatactttaagttttagggtacatgtgcacaatgtgcaggttagttacatatgtatacatgtgccatgctggtgtgctgcacccattaactcgtcacttagcattaggtatatctcctaatgctaaccctcccccctccccccaccccacaacagtccccagagtgtgatgttccccttcctgtgtccatgtgttctcattgttcaattcccacctatgagtgagaacatgtggtgtttggttttttgtccttgcgaaagtttactgggaatgatgatttccaatttcatccatgtccctacaaaggacatgaactcatcatttttttatggctgcatagtattccacggtgtatatgtgccacattttcttaatcctaacatacttttatatagtcaacaaatagatgaatttttaaaaattaatgccttagaagatgtaaagcatattcagtaagctttgaaaataactgaaacccaaatgtcctacaatcatagactgggttccagttattttcaaagcttactgaatatgcttttcatcttctaaggcattaatttttaaaaattcatctatttgttgactgtataaaagtatgttaggaatctttaacttgcaacatgtcatattacaatatattcactcaaggtcaacaaagagtatttattcttagttgactccttctggtattaagaacatggttgaacattttctgttttcaaagtactttatcttaagcttccagttacttgtcttagcaattccatcattggccagtcattcattctattgaacgtctctaatgacgggataaggctagaaaaaaagattcagaataacagtttctttgcaaagatttttcataatgtatcttttaacattgtattatggtttcaatatttgcatctcactccaaaatttatgttgaaacttaaacatcaatgcaacaacattaagaggttgggcccttaggaggtgattatgtcatgagggctgtgcactctgtaccttatagaagggctgaagggaactaactaggcccttttgcccttctgctatgtgagaacacagcattcgtcttctccaaaggatgcggcaacaggcaccatctttgaaacagaggccaggtcctcaccagacaatgaacttaccagtgccttgatctttgacttccagcctccagaacagtgagaaatacattatgttatctataaattacccagtttctgtttttgttgtggcaggatgactagggcatgtaaatattggtattatactcagaaaactcttagatacaaaattttcagtaaatgaaagatgcatttcttgctattttaaaatttgtaggttggcatgtctgtgtatttttcctttatacctaggaatgaagcagttgatatgcaaaaattattgggatttttggaatttaaattagctagccggtggtagagagatgacaagagtttagcaactgctgagagagacagagagagagagagaaatggtaaatagaaaagtgagaatagaagagacttgaatgaaacctattacaagaaaatgaagaatggagatagaataacacccacacacgaatgaaaaatagtaaaagcatttataagaaggaatttaagaaaatagacaaaaagttgtaggagatagagaaaattaaaaaaaataaaagtacagataccaagtggttgctgagttcctattatttgccagatactttaataaaatgcaacagagaaaatcaaagacaagatggacagaaatttgtaagaagaattgtagcacacagaatgaagtatgtagaaagtattatgagtgttctaagaaagaagtggccaatatattgtgcaggtttgtgtatgtttgcatgtgtgtgtaaatgtttttagacaaagaaaacattaaggaatattgattaatgatgaagaaacattaaatatgctttaaattgaaaatattattataacatactaacatatatttatcatttcttatatgccagaaatatactacacaattttcttgcataacattagttaatcctaacagtaatctaatgagaaagttactattattcttgattatggatagagatcagagccttagagaccactcatcaaaaatcatacattaatattttcaggatttgaaaatgttttatctgatttctaagctcatgctcttaactactatgccttaaatatttattttatattcacacactacatgttttatcgcatgttaatcctctgtttctcttttctttgtttatatgaaactataagatttgaatcatagttcctcaaaactatttcattcttaaaatctttttgtaatctattgcaggtgacacagactattactacactcccactttcgcagtataaataacattctttcaactgcagcctggactcagtgtaaaacactgtattcagaatacaaaactcacgtaaatgaaaggctgactttcacagaaccaactgcaggacttgagtatatatggattttggtacctatggtaggtcctggaaccaagccccaaggatattgagggacaactgtatttttatccccagaacttagcacaaaactgtcatatggtaaatttaatgaatatattttggagaaatagacatataataatattttatcacaacttccatcattttcctaaagttccagggggcggggcccacatcattgtacttttgtgattcctacaccacttattactaaggtattaaaatacaatgattaagagtgtggcagcatgatagggattgtattggatcagtagggcagtattaacaatattgagtcttccagtctgtgaacataggatgtctttccacttgttttcattaatttctttcagaaattatttttaatttttaatgcactaatcatcagaggaatgctgatacaaatgcaaaaatgatatatcacctcatgcttactaggatgaccattataaaaaacaaagcaaaaacaaaagacaagtgttggcaaggatgtggagaaactggaactcctatacatgatgggaatacaatatggtgcagctgctatggaaaactgaaaaacaagttctttaataaactgaaaatagaactacaatatgatccatgaatcctacttctaggtattcatccaaaataactgaaatcaggatcttaaagaaatattagcactaccatgttactgcagcactattcacaacaaccaaggtgcggagacaacctaacttttcattgacagatgaatacataaagagaatgcagtatatacatacagtggaatagtattcagtcttaaagggcggaaagaaaatcctgcaatatttgacaacatggataaactttgaagacattatgctaaggaaaataagccagtcacagagaacaaatactgcatactgcatgataccaatcctacaaagtatctaaagtagtgaaactcacagaagcaaagaatagactggtgccaggggaaagaatagaatggtgccaggggttggagagtgggagaagtgagaatatgctaaacaacatgtgtagatatttagttatgaaagataaaaattctagaaacctgatgaataacattatggtataaagataacaaatacagtattgttaaaaactttaaaatatttttaaaaggtagaacctctacttgactcttcttgcaaaaataaaaaaaggatttggcagcatgagccaggtgcctgagccatctttatggctgttagatgtaggatttgtgtgaaattaagcaagatagcttgaaattttaaccttctgtttccacatctgaaaaacaggaataataataaaattcagcttgtgaaatttttgtaatgattaaatagattaaataagatagtatatacttgattgaccattgatttcttcttcctttgccagaaatctggctcaccccagaaaatgctatttttctgtagccctctcactagtggtgaatgtttttatcatattcttccacaactaggacctgagttgggataggtcctgtttcttactccttcttccctattaccactgccctcttgcttaaaaacaaacaaaacaaataaaaaacacttggtatcatatcatcaaactgcctatatttcctcttcctccattctctcttgagccctctccaaactcagtttccttttcaaggttaggaaagtttggaaagagtttcaattattctttaaatttccaatattttaattcaaactggtatttttgtcaaactatatttattacatattaattccaaggggttcctctgataatctaaagtaaaatgtattctaagaaagagaaaattagaaggaatgttgtccagtgaactattgacactgcacccaacccagtacatgaaatgtgtattcatcactgacaacttgtggaattcattaaacaggacagcagcagtgcctttctccagtcagtgtaaatgtagtttttgagaggaggacaccaaaaatgtgacatttgaagacagccatgatttgattatgtgttttcttgttgctttggattgttatctgtctctatccaacataaaacaaaatccgcaaagatgagattttcatctgttttgttgtctgctatatacacaacaggtagaacagggttgggcacctagtagccccttaaaaataaagctatgcaattttgtataaagctatgtaattttgtgtaacttaaatgtaataatacattattaagtgtgttatctataaaatacaatgtgtgtggatgaaggtatatggtataaatacagagaagagtatttctaaggtgtttggcacttacaaataccacaaacgctagttgttattagaaacctgatgttagcataacaggtattacataatgcttgctatacttgaatgaatgaatgaaaatactcagcataaagcattattaatatttgtttataatgatatatatttttttcctggggagatatcatcagaattgcattccatgaatccagcagatcatgtgtggacaaatctttgatacaaccacataaaatattgatgactgtgttaacaatgttcttttaaaacattatctaagtctaagccttaacagatctcatcagtattccaattgttcaatgaagaaacatattaaatgcaaactagctgaacagtcttcactgagcatttagcggggcagcccttaggggcagtataggatcttacaagagtagggaacattaacagcatgaactgggccactgatgtcaggaacagccactgcattatgatccactagcgttataaacaaatactcagaaaggcagctaataatccgacatgagcaaagaagagaggaaatacctgaagaaagcatgaattcatagtttgagttttctacaaatacttttctaaataatacacaatcatgggataaatactaatttgatctgtaataaattacatatatgaaatataacaaaaatactcaacataaagcgtaaagaattattaatatttgcttataatgctctaatttttcctggggagatatcatcagaattgcattccgtgaatccagaagaccatgtgtggacaaatcttgcatacaaccacataaaatattgatgactgtattaacaatgttctttttaaacattatctatgcctaagctgaagagctctcatcagtattccaatttttcaatgaagaacaatatatatgtaatctataattacacatatatgagagattcagttagtgataacccatgatgtgataaattacacatatacatgtgtgtgtatgtgtgtgtgtgagtaaatttttagagattcacttagtattttgtctacacatataatttacctagatttcttgttttcctaacaggatgcaaaaaaggtacactgtggggtgggtaatatctccttactaaatatttattgactgattttgtccccacgtcattgaccagtgtcatataaatcaaactctcattacctatttttgaattgttgtttgaactccagctactatcctcaaagctcaccaacttgcccttctagctgacgcattttatgtctcaatctactttttattcaatgcttatttatttcattaatcacaaattgggtcattctgccaagtcctgaggaaaatataagtaactgagactgtctctgttcaggattttataatctaaccatgaaaacaagcattacatgacatattataaagggaaagatggacattaattttgattgggtgtcatcagtactaacattggagaacaataaataaattagtatcagtaataagtagaattttagtaaaatctagaacaataaacttttgttaaaattttacattataaaatcacaggacagcatgtggctatcgcatttcaagctgagataacagatttgctctcagatttcccacataatagttgaaccacaatgagaaagcaacttgagttccctgtttctttatagttccctgatctctaaactaggcataataatagtaaaatactaataattattgttataatcacaaggaccctatggagtacttgtgaacattaaagaatataatctatataaatggcttaattaataaattctaaataaatgttggtggttactattagtgactgatgcttacacataaaatgactattgatatgattcataatttcaagagacttcttgagtggtgtattagtctgttctcacactgctaataaagacatacctgagactaggtaaaatatgaggaaagaagtttaatggacttacggttccacatggctggggaggcctcacaatcgtggtggaagagcaagtgacatcttccatggcagcagacaagggagagaatgactaccaagcaaaaggggtttccccttacaaaaccatcagatctcatgagacttattaactactgtgagaacagtactggggaaacagccaccatgattcaattatttcccaccagttccctcctagagcacatgggaattatgggagctaaaattcaagatgatatttgggtgaggacacagccaaaccatatcaagtaggtaggaattatgtgtatgaaataagtaggaacattacttaatgttatatgagaaggcactaaatacaatcagtggcaaaaaagtgaaccctacaagcaatcaatcaagaataacttctaggaaggagggagaaagagagagagaatgagtattgttgtaaactggagttccacaaaggaaattgagcttataaatgagccctggatagatggattacgagaaagaaaagggcaaagagagaggatacagtaagaaaagcaaaaagactttaaaacaatatagacagaaggaaataaaatttaacattccaataatggaaaagaatacaatgtgagtaaacaattggtgtatgttgagaaattctgggaaataatatgagtaggcaaagcaagaatatatcacaaagggccaagaaagcttagatgtggacacaatccagtagatagtggaagaaatgttaggagatacttgagaaaagtactgttttaggaaatagagattagcggttcactgttttattaaaaatagctgaaagacagaagctgagtcacttcaacttctgcagtaagcaaagccatagtatgcaaactggcctttaaatccatgggggaatgtattatctcactttcatggtgcacatctatcatgggtaggtgaaagcaagggaaggagagatccactccacctagtcactcaaagataagggctgactgaggcattaccttttacagctgaaccatctgtgatacatatcttcttaagttgttctggcagaagagcgagaaaatgaagaatttcacatagatttttgttgcatcagcccaacaataatacgtcatacttacttatatttcactgcccagagatagttatacagttctgcctaataggtgaatatttaaacaactcatcagaacaaactgaatatttgcaaaatataactgtttcctacaaatgcaatgtgacaaaggtgtaaaattatttatttatttcacaaatgcacatggaacaccaaatgtgaactaagatttcaatgacaaaaaaaaaaaaccacacctaccttcccagttcttatatgcaaggaatttaatgtctaattccaattttcattgaataatctagactaagctgtcctaggaaaagggagtaaatgtagatagaaaatgacatattcccttgtactgccccatttatctcatcagtcattctgctttaaaggaattatctggtcacattttatcttctattcacatctgctactttcaggacctttctttccctcctctttctttgagattttcagttgctgctctgccttgtcttctgtgtccattcttagctccaatcctgagactcagctggagtctcagaggcttgcatctgagcactctgcattgctcagtgactaaggcaactgaattagggcagggacacctggaatagctcagtcctccacagcaggtggggtctgataaaagccatatgcctaagaccctgcagtatcaaagaactaagactcgcaggcattcctaactggaatctatctctatttcagtgttatgggctagattgtgttccccaaaattcatatattcaacctctatcccctagtaactcagaatgtaactatatttggatatagggcttttgaagagataattaagttaaaatgaggctcttaaggtgaaacctgtaagaagatactaggacacaaggagagacatcacgggtgtgcctgtacagaagggcaacaatgtgaagaggcagcaagagggtagatatctgaaagccaaggagagaggactgaggcaaccagctcaactagtaccttgatcttggataattccagtctccagaagtgcttaaatttctgttgtttaagccacctagtctgtggtatttaattacggcattcctagtaaaaggacaacttttatctctgtttccaataaacatttcaatcccatggtaggaaaatgacaatctgcctaatctctgccacctcctaacaaaaatcttgttttattaagaatacaaacaaaacatattttatataattttcttataattttattaatgtctgatgtaccagaaaatgacacataggtattgtatgctttgccttatttgaactcatgataaccctatgagagaggtagtaccattttcctcattttataaacaagaacagatgacttagatcaagtaacttgactctgataacatataggttaagtaggagagctcattcatctaacacggttacctttcatgacaatgatgatgaaaacagctaacagagtatccacgtgaccattattcatctaaaccccttacattaaataattggacattcataatattcctataatgtaagtattcctactagccgtgtgttatagacaaggaaatttaagcaaagagatattgagtaatttactatagccacagagctacagagttttggagccaggattcagatctaggcagtccaaactgaaggtgtgtatttttaaccaccacattctactgcttctcaaagtttggagtaggtatattagcatctggtaatggctgttgaggatattttaaaacttaggtaatgacttctgctattgtatacttttagaaaactggattgggatcaaaactgtccagtacatgctattttgttacctttggattcttttaatacctaaccttgtgcgattggggtcatagcacagcatgtatgatcatcattgctgcaaacggatacacatcttaaaagtgccaactcagtgttattcaaatttttcctgaaatttccatatgcttctcaagttccttaacttgaaaactcaaaattcttcctgcaaacattttctgattatctctactccaaaatgttttaacagttagtcaattagttaattaaaattttaattggcaaataattgtgcacattacatattttggggtacaatgtgatgttctgatatacatttactttgtgattaaatatgctaatgcacaaatttatcacctcataaacttgtcattttatggtgaaaacattcagaatctattcttttagtaatgttgaaacacacaatgcaatattatttattattgtcaccattgtgtgcaatagatcactgaagcttattcctcctctaactgaaatgttataacttttgatcaacatctcctctttcccatttcattgctcactccacccaccagcttctggtaaccaccaaccacatccagtggacagcaagttaaataataggaagttagagaaagctgacagttacaaaggatatgatgttatttaattgttcagaatatacaaaatgtgtttattataggatacagccccttatggaaaaataaatgagagtggggaaatttcaaaatcagacaaaagtaaaaagtactatgttcaccagaagatggagaagtctgataggaagacactcagaaaaggtcagtaaaaaacctctgagaaaaagaaagttgcaggaaaggtaaatcaataatgctgtttgctgaaatgctacaaaattatagtacttgtctaaggaagtagttactggaagccatagagagtgcactttcagtatagttacaagaaaaaccaaattgcagagcttaagggaattggtgaagaactggtagcaacagatacaaagatttgacagaacatctaactaaagaaaaactctattatgaattgtataagtcattgatgactcagagccaagcaagtttataattacatttttgctcaacttcgatttctatgaagaacatttaaaatgagttctgctttttcatacaattagaatgtgggcatttttcaatcgttctaaaattttcagattattagaaccacaaagacaagcatccaccttaccggatattattgattttatatgcattgcctggactctgaattagaccttttctttcttttccctgtctcagcaggacaaataagaacatctaggccaggagcggtggctcacgcctgaaatcccagtactttgggaggctgaggcgggcggatcacgaggtcaggagatcgagaccatcctagttaacacggtgaaaccccatctctactaaaaatacaaaaaattagccgggcgcggtggcgggagcctgtggtcctagctactcgggagcccgaggcaggagaatggcgtgaaccagggaggcggagcttgcagtgagccgagatcgcgccactgcactccagcctgggcacagagcgagactccgtcaaaaaaaaggaagggaggaagggaggaagggaaagaaagaaagaaagaaagagagagagagagagagagagagagagagagagagagagagagagacagagagagagacagagaaagagagaaagagagaaagaaagaaagaacatctgagcaccaatactgggatattgtaagttacctcagaaataacatccttgggtaaggggtgtgtgtgtggtggggtgtgtgtgtgtgtgtgtgtgtgtgtgtgtgtgtgtgtgtgtgttttagcagaaagagaatcttctaagtacaatgaaatgggcttctatttatcagtaccttttttcttctctctcttttagttctgttgctttccaggatatacacatggctttaacagagtctattactggaatacggagaagctattgaagtaatccttcaaggcataaggtcagaacttagagaagtcacagagtttgtatttctgaacctgattaccagaaaattcttctaaagcaggaaaagatatatgctttcaaactgttatcctacaaccaaatccattttggagacacaaggatccacaagattactcaccttcaggaaaacatgaagacaagaaatgctagtcttggtacaacctaatgaaaagacatagctgagatttcatatgaagataacattgagattgcttagaaaaaaattattggagttaacattgaaagtaacaatggtatttcttgtcatccctttctaaatggcatatatggtatgtaatctagaaatatgtacatatacatgtaatagcttacaaagcttccaataaaaaagacaaaatctctggattttgccatctaacgaaaacaatgtagttactattaaaacttgaatttaacttctcagaataaacatacagtcaaggtttttgtttatttctttgtttttccaacatggttgactgacttgggatgctagttctcggaaagatcaaagttacaggtgaatggtaatgatctgaatgaaacacagtcagatgagagccaggacctgtcagagaacccacaagaagaagctagggtacagaaaaagaaagcaggaagagtctggcagagattgacccccaaggaacttagagaccccaaaaaagtataggtgggggtgcttctctgttcccctcaccctggcaacaacctgctaaccatcgaattattagagagtccttctaccctcacaatcctgggcaatgatgtccgtggcaatttggaaaattcccaaagacagaaatccatgttgttaactcacacaggggtgcccacactcttctcaggcctgaactgagatgtcaagtgccgtactagttgtgtacacatagtgggccactgctgtgcctgtagaacctcagtcattgagtcaccacatcacaagatcccctgcaaacataccccataacctgctctgacatccacaatcaaagggaaacagagaggatccctgaggaactgtggatccctggtaatctagccctcagtgtgacctacccctggggaatgggggtgcacagacagccctccaaagcctgccttgagagaaaggaaatgtagtgtgacacagatcactgaagggagtggcaccggcagccgggaatggatatggagaggtagtcatcttctgctcctcccatctactcttgcagacacagcagaggctctaccagttaaaggccagcccttgtgaaattggtgtaaacttttccagtggttttcacaacagctacacctccattcaaagtaagcccctgccacagaggcttccatgaagagtaagacccatctctccccttctatacaaagaaatagcatcccagcaactgaaggcagacaagctacaaagttgtctgtcatgaacttggggaagaggatttgccctgagcccattttgttggtagctgccggaggggcatacccatggtctccagctgcactatggccaggagtcaaaggacaatgtatatttaaactgaaggtcatgagcaaaatgcaacagcggcatgatagggaagcagatcacattcctgtctgcccaggatgaggacctggtataggcctccaacgctcttccattgaaacattgccacagcccaacaggatctccaccagctacacctgtcagggtgggtgcctccagtcattactgagctaccagagaatgagcaggctcttatgcttaagtgccatcactggactggagagtaaaatagaatacctgttctcagaaaggcacagggctagtgaataagataagcttcctgagacctctgtactctcagcctcgcaggagatagtgtcagctgacacatctaacacatcaaaacaacaggcaacattcaagaaaaccaccatacaaagattacccacaatcaaggaacccataaagaactttggcacactgaaagcaccccaaaacaaagcatatcatacacatcataacataaatcacagtaatcctctaaaggaaaaataaatgatagaaaattcaaaaataagaagtgatatctcctttagatgagaaagaatcaatgcatgaactctagcagtacaaaaaggtagtagagtgttttgacatctctaaaggattgtacttgcactctaaccatagattctaaccaaaatgaaaatcctgaaatgacagataaagaattcaaaatacagagtgcaaggaatttcaatcagaaaaatgatgaaggatataaaaggcaaaatagctatattagaaaatagaacttcatgtattgaaaaagtaactaaaggaatttcaaaacatagttgaaagctttaacaatacactagaccattcagaagcctggtttttttgaattaaccctgtcacacaaatataaagaaaaaataatttttaaaaatgaacaaatccttcaagaaatattggataatggaaagcaaccaaacctatacttagaggaattcttgaggaaggagagaaagaaagaaacatgaaaaatataattgaggaaataattgaggaaaattttcctcatcttgtcagagaggaggacatccagatacaaacaatttagagaatatctgtaagatattatacaaatgaacattactaagtcataaatttatcagactatccaaggtcaatactaaagaaaaaaatcttaaacagtaagtatcaaactatctataaaatgtagtcccattagactaacagtggacttctcagcagcaaccttacaagccagaaggaattagaggtctattttgagccttcttaaagaaaataattttataataaatggcatccaaaatttttataacctactaaacttaatttcataaacaaagtagaaaaaaagtcattcccagacaagcaagtggtaagggaaattttcacccatagactggtccttcaaaaaatccttaaaggacttctaaacatgcaaatgaaaggacaatacttgctaccagaaaagcatatataagtacaaagttcacagatcccataaagcaattacacaattgaatatacaaagtatctagctaacaacaatatgacaggaataaaacctcacatgtcaatattaatcttgaatgaaaatggcctaaatgctccacataaaagatatcattttgcaaattggatgaaaaagcaagaccctaccatttgctgccttcaagggactgacctactgtgtaatgatatccacagccccaaagtaaagggtggagaatgatgtactacacaaatagaaaacaacaaagatcaggggtgctattcttgtatcagatgaaacagatattaaatcaagaaaggtaaaaaaaaagacaaagaaagatacaattcaacaagatttaactgtcctaaatatatgcacccaacaccatagcacccagattaataaaaacaactagacctaagaaaagaaacaagtcatacaataacagctgaagtatttaacaactattagttatataatctgtctggtgacagcaccagatagattatcaaggcaaaagaaaaccaacaaagtaactccagacttaaatggaactcttgatcaaatggatgtaatagacatctacagaacataccatgcaacaaccacagagtatacatttttcacatctgtgcatggaacgttctctaaaattaaccaaatacttggacttaaggcaagtctcaataatttcaaaaaaatcaaaattatgccagttatcttctcagatgacagaggaaataacattagaaatatatatcagccgggtgcagtggctcatgctggtaatcctagcagtttgggaggctgaggtgggtggatcatttgaggtcaggagttcaagacccacaaggccaacatggtaaaaccccatctctattaaaaatacaaaaattagctgggtgttagtggggcatgcctgtaatcccagctactcaggaaactgaggcaggaaaatcgcttgaatctgggaggcagaggttgcagtgagctgagatagcaccactacacttcagtctgggtgacagagtaagaccctgtctcaaaaaaaaaaaaaaatacatatcaggagaaactctcaaaaccacacaagtacatggaatctgaacaacttgctactgaatgattttaggctaaacaagaaaattaaggcagacataagaaaaagttgaaataaataaaaatagaaatataactcaccaaaactctgggatacaatgaaagcagtgttaagaggaaagtttaaagcactaaatgcctacataaaaagataaaaatatcttaaattaataatccaatatcatacatcaaggaactaggaacataagaacaaaccaaatgtaaagctagaagaagaaataacaaaaatcagagcagaactaaatggagttgagactgtaaaaaccaaacaagagattaacaaagcaaaagttgtgtctttgaaaggataaataaaattgataagactgctatttaagttaattaaggaacaaaaagagaagattctaatacgcacaatcagaaataataaaaatgtggcattacaaccgataccacagaaatacaaaatatattcagagtagtctatgtaaattctcagagagtaatcatggtagactatgaatatctctgtgatcaaaaacgagaaaacctagaagaaatgaataaatccctggaaacatataaccagccaagattgaaccaggaggaaattgaaatcctgaagagacatataatgagttatgaaattgaattagtaataaaaaatccattttccaaaaaaagccaggaccaaacagattaacagccaaactttaccagacatagaaagagctagtacccatcttgtataaactaataaaaatattaaggaggaatgactcctctctaactcattctatgaaaccagtatcatcctgataccaaaacctagcactgaacacatacacacaaagaaaactacaggccaatatccctgatgaatagacacaaaaatctgcaacaaaatgctagtgaaccaaatccagcagttcatcagaaagataatttgtcacagtcaagtggattttattccagggatgcacaaatagttaaacatatgcaaatcaataaatgtgattcaccacagaaacaattttaaaaacagtagccatatgatcatctcaatacctgcagaaaaaacattcaataatatccaatatgtctgtatgataaaaaccctcaacaaactaggcattgaaaaaaacatactgcaaaataataagagccgtctatgacaaacccacaactaatatcatactgaatgggaactgtaacaagacaaggatggccactctcagcaatcaggcaaggaaaataaataaatgtcttccatattgaaaaagaggaagtcaaattatctctgtttgctaatgacaatcttacacctagacaaccttgatatttcctccaaaagattcttttacctgataaactacttcagtaagatttcaggatacaaaataaatgcttgaaaatcagtttcatttacatagatcgacaacactcaaactgagaaccaaataaaaatctcaatttcatttataatagacacaaaaaataaaatatctagaaatatatttaacaaaggagaccaatgaggtaaaagatgtccacaacaagaactataaaacactgctgaaagaaatactacatgacagaagcaagtggaaaaatatcccatgatcattgtttggaagaatcaacatcattaaaatgactgtactgcccaaagcgagctacatagtcaatataatttctatcatagtaccaaatttattactcataaaattataaaaaaaaattctaaaatacatatggaaccaaaaaaagagccttaatagccaaagcaatcctaagaagaaagatgaagttgggggcatcacattatctgactttatactataaggctataataaaaaacaaacaaaactcagcatggcattggcataaagatggacacatagatctatggacacaatagggaaactagaaaataaaatcacatgtgtataaccacggttcttcaacaaagctgacaaaattaaacattggggaaaggtcaccctattcaataaatggtgctaggaaaacttgcttgctaaatgcagaagaaagaaacttcactcctatctctcaccatatgcaaaaattaactcgatgaattgaaaatttaaatttaagacctaaaactatagagatcatagaataaaacctaggaaaacctctttagacattggcctaggcaaataatttataaataatacctcaaaagcaaatgcaacataaacaaaagtagacaaatgggacttaattaagccaaagagtttctgcacagcaaaagaaacaattattagaataaacagacaacctatagtatgggagaaaatatttgcaagtaatatatctgacaaaagatttatgtccgaaatctataagaaaaacaaatcaacaagaacaaaacatataactccattaataagtgaggaaagaatgtaaacagacacttcccaaaagaagaaatggaagtgaccaacaaacatatgaaaaaacattcaacctcactaatcattagagaaatgcaagttacaacaaaaatgagacaccatttcatcccagtccatttgtactttttattatcatatatatcctcaaattcaaaacaaaataaaccacaacataaactgtgttagtatagtacattaaagtcagctccactgtgctgtatcacttggcaagtctgaaattccaatgggcttcagaaagttgactatgcaatgcccaataatgacctgataatctcatattagaggcaatgcaaatatatttataagactaagagctacaacaagcttacgaagaaaaccaatttatagcattacaggttaaaccagaagtgatttcctctgttaactaaaattacattactaaaaagtgcatggttcgtggatgtctaatgtgaaaaaagacagacagtgaatactttcctgctcagtgtgaacacttaataagaatgaaaatagaatgccttattatataaagtaataccaatacattgatttccaatctactcctctggcacaatttaaaatgagctcttgaactatagagtcacaactctttttcatttcaatgtgttttccttcaaaatagcagttatttatacatactgcttttaaaaatcatttttaggctgcagattcacaatctccataaatatcaaagatgtgaagttaagttcagatgcacttgaagtaaacaccatgctaactagcagcagtgttcaagagatcatgctgccgatcttatgaaagggaatatactattgtgaattattttgcaaatcccaaaagaagtttatctctcacattattgaagactgagaatgtcttaatatatgcacaacttgaacattgtttgtgaaaaagccagactaattcatctatcttctgatcaatcagtttagccaagcaaagcacaaaataaatgcacatcctttgctgccgttaagagcaaccagtttgcttgtctgtgcatcatgaatgccaaacaaatcttgaataagaacgaggaaaagttaaaagaaaagaaagacaggaaagaaataaaactcaattttcttgaataggaaatttctagggaggaaacattttccatttttgtcttctatcaaatttatatatatataaatatatatataacatattatatatatcctaactgtcattataggctattctaagacagattctgccaatattgaaatatctaagacaggcacaattgggccattgcaaacatcatgtactaaatggattctaaggaacctgaaaattaatgaatctttctaaaatgactgacttactgttaggggaaagcttaagaaatcaaataccaaatcaaataccaaaataccaaatcttttttcatttttctattcttcccaaaaaaaaaaaatagtgggggataaaataacgcaatgcccagttaaagtgccaacaccaaaacaacttatggctgctacttctgaccctttcagggggtcaaattttgttgtcttttgtatttctagctttgtttgagacctttgtttgcatatattcaaaggttagtaaatacaatttaatattgtttccacagaaattaagcatttacctagttagaataagcattcaaacagaggtcttgcattaaattttgtactaaactgtattccttctaccatgctgcaatctttattaagaaacaaaggacatctgatttcacttttctaagcttattttagttaaggttaattattacacagagatactaacctttcaatcataaactacaaattagcattattcatctctgtggtatattttcaatgtaataataaaaatcctggctcgctctaaaggtcaagctaaaagcaaccttaccatcatcatactggcccaagcagatttcaaagagagagcccaggatgatccctgaagctaaacatgtccagagataaaactgtcgaaacatcttctgtcaaagttcactcaaagctgatctgaaataagaaaaggtagaaagaaacatttgacatgttcattaatctgttataggtaaacacaattgtcacagcacagaaaagccttaatgacttcatagttaattacctgtgccacattatccattaacaaagtaacacactggtttaatgcactggaactgtttatcaacataaatttgcagacaagtaatctctaaggaaagacatcttttctgttatttaatttgccagcaagtaggttgagaagttaacatactaataatatcagaagcacactctttaaaatttaagacattatgggtaagtccaatgttaatcagtttaagttactaaacttatgttgtctacagcataattttacaacaaagtgtaagatagtaagccagttgttagtatcctacatgagcatttcaatgaaaatttgtcttatacaattaagtagaaaagcccatcattaaaatgttaattcctttctagtagagtgatcagagattgacttaactatgccaggaaagactaaggaaaatctgtcaattttcactacatctgctttatgaagcatttggatgcatttcattttaattctcttgttttacttttcaatccccagcaagttaaaaaaaaaaaaaaaagaaagaaaacaactgattgagaaattagtggcctgtgagcacatgagaatgtcttattgaaagaatgacatcctcagtttctttgtaaatttaggaaattatccacacagaattgttcaaaatgctcttgattataaattgtggcagactagggattggaacactgtttctctaattcagaggttccaaactcaaatgcctacagaggacaagcagacaaaggaaaagaatgaattagccaaaggggacaatagtgatggtagaggctgtgataaactgtgcaatgcaaggttttctaaagagaccagctggtgctcaacttctgtcagtggttgtgatgtggcaatgcaagccagtgtttctgggtcttctgattttcaaagagaaggcagaaatccaaattttcatgtgatttccaagtgtttacatgattgtgcaatcttctttataagactaaatgcttctagcaggtaatattgatgtctcaagttctccagttttctatttctgcccaggattctctctactagactagctgaggataaggtttatcagagggtacaaaggcacgattttaattctgcttttgtctacattttatttttgatttattgccaagtatttaataatgtttatttgtccagcagcatgtataaatatatatattgcattgtaaaattgtattaaaggtgtaagctctttttttaaactaatgggatacacagttcttgactttaaaagatcactgctctagatcacacacattttaatatgaagtctattcttctttgtttctttatctaagatataaaaggagctgccttctttttaactgggccttccacattttttcctaactggcaaagtgcttggcgcgtgcatttataatttctagggacagaaagcccaaagaagagctcattattagatgccaagagatcatcacaatccacactaacctgtagaaaaaagaaaaataaaattgaccaatgctactggttgtgtagagcagcggataagaatgtggctttttttttaaattcaagcttttcagcttactagttatatgactttgaagaaattaaatagcatctttgtctcacatttctcattatcataatggatataaaatagtatttacctcataagattgtcttaaacattaaatacgtaagggaatataaatacgtgcttaatgcagtgtacttacagaatgagtaccccctaaagcttaatatgagtaccccctaaagcttaatataaaagactcagcatctatggaacctccaaagtcttaaatacagatttactcaatctatctttagcaagggctggaaagtagatattattatccccattttgtggaggaaaggtcaggctcagagagaataagtgactggctcaaggttataaactggtgagtgtctgaagagaccataaagtctgtgagtaagacacttctgctcattccattagagaaaagtattggaaaaattcccagaaaacacagggctcagaagttttcaaggcatatggaggcccaggagagcctgctgtattgcttcccttaaactctgagagagacattctaacccccttcacaaaggattagagctctactaagatttctatatacaatggcttcaaatctttttttatttggaaaaacaaacatgacattaagaaataaaacaatgttatttaaattttaaaaatataaagagaaaccatatacaaatacaaaccagaaaggatatatattggaaaacaaaattaatacaaaccagaaaagatatgtattagaaaacaaaattaaagagacggtaatatcttagcaaaggacaaaaggacatagttgtgttcctgtgtgggtccttgatctgccagcttgacttcctttatagtagtttatagtattatgcattcacaaattatggcatattcttttattcctaactgaagctaatttggtttcatggaacagtctccaatataaaaacaacatgatggatcattattttaaaatcattaatgtcactgccattattatgcctccagaaacaaaacctcttgatctatggctctgcaagtttttagaggattatatgcatatttctgaaagcatcacagacaaaactcataaaaaatctatttagaatagatatagcatttactgcccagaggaaggagataattttaggggaaatattatacttatttgtctttgaataatgataataataacaatttctatagtttttttactctttcatctatatctgcctgatttccaaagaaattttcatcacttcaatgggctcaatatttacagagacctgaaagaaagctatgactcatcacatcaacccgataccccaaaacacagaacacatattgacttagtgagaaaacccagtttctaaacaaagatataatgaaaaggtacctcccacaaagagattgtgtaaatgactacaggaccaagatgtttagtacaatattgtgccaatcaactgacagcctatagtggcacttctgtgattgtgatcaaattaattggaagagatcaaatgctttagacaaaagactgtttttgttactagctttttaatctctagaattaaaagagaaagtcctataggagatgaattccataatcttgctaagtgactgtaggtaaatgaaaagcctgtcaaacaacacctctatggtggtactttacttttactacaaatcccacatcaaactctttccatgttccccgagtatatatttttcctacagaatttattggctaataatgttatgttctaaaaatccaaagcatgttcaattctaaaaagaattgtaggtgacctataaataaatatgttatacttgttttttaagagataattaaattggtgtattcagtactctaatatagctaataaagttatcattttgcaatcgtgacttagaaatagtattctgttgtcaaaatactggggaaaagtgtttttttcctattacagtataatattacacgtaagtggtttgcattccatgtgcattttatgacacaatttccttaggcttaagaatattttactgcaattattcaagacaaacatactaattttgaatttcacatcatttgtatttcctgcaagataaatctcatatttatttatctggcattcaatgttctcaaaaattaatttattcaacaagtacttatggagggtctactagataccactcactcttctaggcagttggaaaatatcagtgaacaaagctgacacatttcttttctcccatggatgttatattccagcaaaataaagatagaccaataacaaacataaataagttatataaaatgttaaaatgtaataagtgacatgaaaatagcagctagcatttcaaaactgtatattgtcactttacaataattttcattcagtaaatgaagtgagattacacaaagcaaccaaaatgctatccgataaaataactgaatgagaactttacaatgaaagtataactattccgacaaccctgacagcatccttgatggtatctactattctgagtacagatttctgtccatctcttggaaggagaataaaggtctttcactgcctttcactttcaaatataaatccaaagtctggaaatacacaaaggtctgtcctttttctgtttatccctgctccctgagtcttgggtgtttgcagtgacacatggcaaaagcagccaaggttgacaccacagcagttttctcttaaatacaattttgacaatgttaactattttttagcctatgtctctgactgctatgtgaataaacactaactttcttgagataccaaaacttggaacacaccgtcattactttgatgagaaaccccataccaatacacaaccatgaagcaagctggagtctcacagtgaagtgagctgtatgtatgcagtctgcccttcaacagttggttcagccaaattactgttattcttgatctgtaacaatatctagataaagctacaaaactaaaacttgtcactgctttgtattccttgtgagaaacgtatgctatctacctgctggaataaagcaaacttcccttcaaagcaacctcagcttcaaactaaaaacatgaggttttccaaagtcactgtatcttaccatactaaatatcaatttgcttaaatgactagagagaaacctgtcttctacctcagcatggtggtaaatattaataatgtcttcatcagtacagagggtacttatcacccttcagcattaccagatgaatcagctgttccttttttaaaatgtgtaatatgaagtttaggaaaataaaatttcagagagcctttcagatatattccttccttctagatcatattatatttttctttactaaatatacatatgtataagtttatatcatatattcatctataaaaatatattgatatttattgacaattttatagtacatttatacatatttatatataaaattatgttacatagtcacatatacaatttatataaagaagtatatattttatttaaatttacattaatgataggtaatatcaatgatattgatattatcgcccacttttttaaagtttgcaatttaaattcaaggggttccgttgtagctaatttgaggtaagtttggaaagtaactaatgtttttataggacactgtgaggtccaacctacctctcccacccggtcctgctaaattcggcttactagatctttgctcgggcttacagttttttttaacatgctactacatctgaatgtgtcttgactaccaaatttaaaatatgtgctaatttggccaggcgcggtggatcacacctgcaatcctagcactttgggaggttggggagcatagataactcgagatcaggagttccagaccagcctggcaaacttggtgaaaccccatctctactaaaaatataaaatattagctgggtgtggtggtgcacacctgtaatctcagttactcaggaggctgaggtagaagaatcgcttgaacccaggaagcagaggttgcagtgggttgagattgcaccactgcacttcagcctgagcgacagagcaagacagattccatttcaaataaaaagaaaatgttaatttgctttttgggtgcactctgtctcaacatatagattcatcctaaacattgtgggataaaataaaattgatgaaaatcatttttaaaattaagaatataaattattaagaactaatcttgctatcacttcaatcatttacaaggtctttcatttcagttttaaacattttaaatatataatcaacagttgtaaacattagatgagactaatttaacccaaaatatatttcccgaaaccacatgaaacacataaggtaagtccaagctctggcattcttatactacagctatggtgaattcttggagaattcaaatcagtgtcttaacatgtctgttgagtctattcattattaaattctggttttaataatagaactttaaataaaagagggaagaacactggttttctttttggggaatactacttctcaagaaaataaatgactgaccaatataattaatctgcttatgtttaaagattgtgtcttcatggaaaaaaactaatattcagtttagtctataatagatacatgccaaatgttataataatgtagtcatactagttggtttaataaaatataaatacaccaaaaatgtttttaaatgagtggaaatttaatctccatgtttactattgctattatattggatattttcttagtgtttatacatacatttactcaattagtatttattttatatttagtgcatatcagacactaagcttctactatagaaataaattattccatttcctcacaatgactttgctattgagcatgcactacatttcatatttttttacctaatatacatttcaaggtactttagtaaaataactccaaattaggagataaataagttttaattgccaatttttttgaggtttccattccatctatgttttcagaaccttcatctaaatctcagtcttttagataaatacatttctcactatttgttagaaaagtcatgggaaaaagcttagtttgaaaggagcaagcaaagggaaatataaaaagagaagcccaaacattatttcatcagtggagtgtttagcttaaaaatataaccaagtaaatttaaaatggagttttaatgctcaagcaaacgcatgcatcattttaaaaaagaagcttgaaagagagttctgtgcagtgttattacctggcacagaaaaatgattctgattaatattcttgtttgatgaatattatagattctaagaaacacaaataaattaatgagtaaatgagtattttcctaaggcaaatccatcagcaaaaaaaatccaaaagtattaagtcagtcaacagagactaaacgtaaaagtatgaaaatgtcagtgacttgtataatgtaatataataaaagtcctggctctggcatgagagagtcttgcattgcattcctagttatgttgcttttggagggctatataagggtaaactagttaaaacttgtgagaatcagtttaaaattaggacaataaaatccattttattcttctgtaattgacagatgaaaatttgaacaaaaaataaaagttaagaatattcatttgttcatttatagcataagtgtttactgagcactgattctggataatgcactttataagatgcagtggctacagctttatgagaaaaactaaatgaattaataataaatacataatagtccatatagagttttcagtctaacagagtgtgacagtcacacctaaagtagctcataatgaatcaaatcctcgtataatactattctatagatcaggggttcagtactggtccatggcctgttaggaaccaggccacagagcaggaggtgagtggtgggtgagcaagcaaagtttcatctgtatttacagcccctccccatcattcgcattaccgcctgagctccgcctcctgtcagatcagcagcagcattggattctcataggagggcaatctctattgtgaactgcacatacaagggttccaggttgcatgttccttacgagaatctaatgtctgatgattgatctgtcattgtctctcattattcccagatgggatcatctagttgcaagaaaacaagttcagagctcccactgattttacattatggtgagttgtatgattatatcattatatattataatataataataatagaaatagagtgtataataaatggaatgcacctaaatcatcccaaaccactctcctgctcccagccccaggtcggtggaaatttatttttcatgaaaccagtccctggtgccacaaacttggggaccattgccatagatagtggaatctatgacttgcttctaatgtgtagaatatgataaaggtaacaagatatcactttattgtttcaattaagttatataagattcagtcttagcacattggagaaagataaatcttcctgctctgtgtaaagaagcaaacgtattgtaaactgcctttggagaaggacatatgccagggaactccaggtgacttcttggaccagaggatggcctccagacaacagccctcagtcatataaccaaaaagaaatgaattctgccaacaatctaaatgagctttgtaaaacaattgcattccatattgttaattatattttgaaaagaaatgtaatttaaatactaaataatgagattttattttatatatgatcaattatatacaataaattattttcttataaatctagttacaacttttctgtttcttatattgaacaaattttgagctataactcagtcatattactttacttgcttttgccattaccatagcttggtaggaaataaggttttaaataatagtcttttaagtaggtgacagatttagaataaaagattcataacagttctaattttaaaaaatgacttcacatgtttaatgacatagcaaacaggtagtatctacattcctaattttttttcttaaatctgcttgcatttaaacaatgtaaaattaattggtaaagcatgtcatttaaaaaaaaaattaaattaaagttctgggatacatgtccagaatgtgtaggtttgttacgtgggtatacacgtgccatggtggtttgctgcaccgaccaacccgtcatctacattaggtatttctcctaatgctatccctcccctaacctccccacccccgcgacaggccccagtgtgtgatgttcccctctctgtgtccatgtgttttcattgttcagctcccacttacgagtgagaatatgcggtgcttggtttttctgttcttgtgttagtttgctgaaaatgatggtttccagcttcatccaagcatgtcatttttattagatatagttggtaatagaaggaaacatataacttttttttgttgtttgtttgttttgagatggagttttgctcttgttgcccaggctggagtgcaatggcatgatctcggctcactgcgacctcctcctcctgggttcaagcgattttcctgcctcagcctcccgagtagctgggattataggcatgtgccaccacgcacggctaattttgtatttttaatagagacagggtttctccgtgttggtcaggctggtctggaactcccgacctcagatgatctgccctccttggcctcccaaagtgctaggattacaggtgtgagccactgtgcccggccaacatataacttttaatagttatttaaatattaatatgtatgtaatggatactagagtaaatactgattgggaaatacaaactgtcattaataaaatatttgttttctatatagctttaatatgtactttttaacatgtacttacaacatttatttaacacgaatagagtagaaaatgtgtactttaatactttgccaggtgacatgtttaagtagaatgaataaaactaggtttatcctccattgcccctcttcttatcagaggggtcatatttcatatgtcatatcttttctacactttattttctacttcacattatatgaagtctaaccagagatcataaagtttcatactatatcaatgcagaggcagaatcaacattctatacatataactttttactttctttgcaggattttttaggtaaggtcttcggccaactgaactgcaactgtttcatttacaataattttaaaacagtaaaattctctcaagaactaagtttgtacatttgatgttgataaaaataatgctaatggtgaatattttttgagtatgatagatgttgatattattgaaatcattagatatgctttaataactttaaaaccaaatggtagactgttccatttcatttctctttgtactttaccaatttatactatgaaaatcatgtatgaaatgtatagtctagaacgtttgcagaaatatcatctcaaaaacagtaactcaaagtctaatacagaaagacatccatataaggaagcatttcacaaatatttctaagctttgatttgatatatattaagcttttaccatttatcttataaatctacatggttaaagaaatgatcaaccttctcaactggcacaatgtgaagatggataatttgacttagaaaaataactaattgtgtagtcatgtaagcccttcatttatgacacaaatccataaaggtcactgtcatatttcttagagactggattttaatgtaaagctgagttttatttttctaggaaactgtaacttttattgaaaatagttcatgtataagcagatttatggaattcaaactcatgttgtccaagggtcaattgtgtgtaattttataattgtaaaactctgtcttatctgtaaatgataagatattacaattagttggttctttatgtttgaggggcaaataaaatttgaataagttgtcttactcacaaagactatgcttcacgaataatacactaagaactttagtctcttcctacaaatacctaattttatagtgtatcctggcatttcaaaattaccaaactgaaaagtagtcgttctctctcttagtgtcaatgctaattgtatggtacgttcattactagagtacattttttctaacttaaatttttaaatttattacattaaatattagattatgctattatatagtaaattcaaactgcctgtataatattgtatcctattaaaatgatacagacattaaattttatgggcattctaatgattgttttccatttttccatacttttaaaataagttgttatatgtcccttggggatggggattattttaggaatactttactacttattaattttccaaaagtcaataatgaaaaatatttacttcccaacacaccctggcaagatattttataagtgaaagacataatttcattctgacctttttaattctaaggccttttcatgttgttttttttttttttttcaatctgatctaatttttaactctctctatttattaccataaccaaatttcattttactttatttttagctagttatttctgcctaggcattttctcctttttcatatttcgacctaagaatttgttcctcatgtaagacttctctgacaagtcacttcctcccccaagtataggtcaaatattttgcgataatccttagcctttcctttgtattcagcgaacacatctcagtttataattacattgcttgtcagtgggtactttggcaatatttgtgtttcactttatgcccctgagaagaggaatcattattagccaagctcctatcccagctttttatcccggagcccagcaaatagcttagcccagattagcattgatgttttgaatgaatgaattttaaaaagaaacgtatcattttcacaaaatgtcctgttatttacattaaagctaatttgttcttgtcaaatctgtattatatatgaaatttagttttaacacttattcctgcagcatttgctgaatatgcaaggatcgataattgataaattctaaggaagttctatttcctttaagacacatttaaggtattgttggagaaagggctatgaatattgtaaattctcacagagagtatggagatgtttgtacataaatatatacttattataaaataatattttaaatcgtcgaacttagataaaatatatgcttataaaatataagaataaaattctaatatacttggaaaataagaaccaaatctcagcctgtaagttaaaacttatggtttatatacaacaaaaactactggggctgtttttatttctgtgacccaattaaactaatcttttctcaaatttcatccctatgtctgagtatactaatattggcaaagccctctctatcctaaaataatgtctattttaatatgtcttcatagaaaagtcattaaaaagcagtgaacatagccactaagtatgattttaatatttttgttgaaatgactaaattaatagaaagtgacaaaaagtaccttaagaagaattttaaaaaacaaaaacaaaagattgaacaaagcatatgtggaaatataaattataattttcttccactttattaacactcttgtctaattagacaataattactttaaaaactaacactttccccttagaattactgctgaagttgaaaggttcaagtttttaattactgctcataaagcatgcagtgaaactttctaaactatgaaaagtctactatcttacgattcagcaagatatttatcttataaaaacatcattaataagtacaaaatctcatttaaattaacagcaagaaactttcattttcctttccagtgtcagagatgggtgaaataaatcaaaatcaaggatcttttgtggatgaaaggaagtagaaatcttaagactagaaactcactaatgtgatgcccatgggcaaagatgaaatcagatattacagatgattttgaagttgcagttttaataatgataaaggtatagtgaaagggagaattgaagcagaaatgaatttcatactgttgcccacaccaatcaactcatcatgcatttcaaaagtatattccggcacaacatggtggctcacacatgtaatcctagcactttgggaggtcaacataaaagaatggattgaggtcaggagttcaaagccagcctgggcaaagtagcaagacccagtctctgcagaatagacaaaataaaaaaattagccgggagtaagggcacacacctgaagtcctaccactctccagaggctgatgggggaggatggtttgagcccaggagttcaaggttacagtgagatatgatcgtgttactgcagggacagattgagagcccaaaaacaaacaaaacaaataaacaaaaaagtatattccactaataccttgtaaatgggggtgtatgaagtttttttaaatcagatataatgataatagcgtgtgtgcatggcagtgtgtgtgtgcgtgcgtgtcaggttgcatatattaagtgtaaacaccacagttatttcaggaagggatcataaatgcataagaatctaagtgtccataaaataccgtaaataaataattaaagctgattgagaaataatgggggctctggagactgtgcagaatttaaacttagcaactttgcagaagtctacgtctattttttccatcttccaattttttaggtaacattgagtgtctggattttcatatgcaattatgcaatttattttaattaaactattttctagtgtatagtgtggccaaggaaacgcagctttatgtgccatccagaccatgttgcaatagtttaaagccttgggcttaaggatctgttagtaacatgacatttgtatgatcagagctatctctccatacgcatttaggaccactgtactatcatcacgtccaaaacttcctttcataatcacaatctttgaaaattctcacactttagagtatcttcctgcctagaaaaatctatcacagtaatatatgcactcaccataaagataatgtaccaggatgctgaggatatactaggtggaaattttagaactgctgttgttcaggattttctcaaaagagaaatattcagaaatatcaggtagttactttacaaagtaacatatataaatatatgtatatacacacacacatatatttatatatgcacaaagggtttcttaaatgcacatgtacctttaaagtaagaatgcattttgggcatagtcatcaccaacacaaagttcattcttgcctcatgtattgatttatgctttaaattttgtaatcatgtgagcaatctttaaaatgataccagattcccaggttaaagtcatttggatgacatttatttatgttttttgtactattttgagtttgagggatggtgttagaaaatcttgtaaactagcttttggtattttctgattattattttttattttttggtgagcaacactaagactggcatttcaacttccaatgagggtccttatataatactcagttaagcatattactgctaaattcaaacaaattttaaaaacaaaaaaagatataaatgattgaaagcatgacaaacgttccctgtagatgttttctaatttttaatacattgaattaaaaatatgcctttccaagtgaattttagatattggttaccaccttcaagatcatcatttatgtatttgtgaaggtgaaagtaggaggcatacataatattatatctgtaataaatgtaactttttaaagtaacataacatctatatatggcaggaaataataatgatacaacattaaatagatatagacctgatgatatagttggaattctccaaactcttgcataacacttatgtaatcaatgtgaatttaaaaacatacaattggccgggcgcggtggctcacgcctgtaatcccagcactttgggaggccgaggcgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcgtgaacccaggaggcggagcttgcagtgagccgagattgcgccaccgcactccaacctgggagacacagcgagactccgtctcaaaaaaaaaaaaaaaaaaaaaacatacaattgacaataatatatgtgatatagtagattgtccaatattttgttggtctaaactacaaaatttgccctgatgattggtgtattgaagagaaaaacaattatttgtatctcatgatacttatcgaaagagtttgtagacaaataaaaaacacactagcaaaacacactctgtttcatgttaattaaagggagaaatactgttcacagaaattagcttccaaaaatcattcttcgtgaaaacacataagtaaactaattttaatactctcagttataactaaaatggtatcatccactatcttccactaactaagtattaaatacagagcataagctattccaactgacatattaaacaactttaagtatggcttatgtctataattttcttgtaatctcattctgaatggagctttcttgagcaacagtaattacagaggagttaagagtctggaaatagttatttgtttatagaaagaaaaactaataagagaatgaacatacttagtctaattagaaaagttttgtttaaactaccattagaagtaaaataatgccacaaactgaaatgaatccctggatattcttaaaacattattgttactttagtttcttaaaaacaaattaagcagacactcattttttccaatagcttgtaaacttttgaatcttgggtataattttaattcttgagagtgtcacatatttgataaagaatgtttgtctaagatttctatgcatatgtgtatttgagtatatgctatattaacatatgtgtattagactgccaagataaaatataactaatcaaagcatttattatttaactttgattaaatctattagcttctttacagattttgctcatttgtaagaggaggttaggtttcttcccccaggataaaagggatgagttatctgtttctcttgggacagatgtactgtggtaaatgcagtgataagagataaatgaaaataaagagaagcccctaaccaaacagaaatgaaaagaacaataatagaaaagagtgtctggggacagtgttcgaggttactttttcttttttctaaaatgattttttgcaattcatgaaaacaagcctgaagcgtaaacttgtcatctcattttaagatgcatttctcctaatattaggtattaaaatataatgatcaggcatatttttaagactcttttcaccttgtttgaaatgtattgcttcacaaagtctttgtggagctttctttttttttaagaaaagaagaaataatacaaatatagtttaggttgtgttaatgcttgaagaaaggtgtaaagggagtgatatgctttggttgtgtccccacccaaatctcaccttgaattgtaataatccccatgtgtcaagggtggggccaggtgaagataattgaatcacggggcattttcccccatactgttcttgtgatagtgaataagtctcatgagatctggttctataaatgggagttcccctgcacaagctctcttgcctgctgccatgtaagacatcactttgctgctccttcaccttctgccatgattgtgaggcctccccagccatgtggaactgtgagtcaattaaacctctttcctttatacattatccagtcttgggtatgtctttattagcagcctgagaacaactaatacagagagagaaagaaggttggagtagggagaagattgctagggtattaaaggaaagccctctgaaaatgacacttgagctgagacctgaataaactaagggatattttagagaatcccataacagggaagcaggcataccactttcaatggctctgagtggggagcatgccagccatggatgagaaacagcaaataggccagattaataagagggagggagtagtactagagatgagagacgtagccaacaagaaactgagagaatggaggtgccacttactggaatgtgatcctccctattggggagcggcaggtttggagtagaaatcaagagtttggctttgattgctcaaataaagtttgaaatatctattaaactaccaaatacagatgtcccatagattgatatgaatgaatctgaaagtcagggtagacaaaaaattgccagtcatgaaatgaacatggcactaacataggctatctacggaggatgtacaaagagagaaaaaatcaggacttgcaaatatttagaggtcagaaaaataaagggtatgtggctaaagagataagaaggagtgagagggaatgcctgaagccaaatgaagaaaggatttcaaacaggagagaatgctaatatgttgagtgccactaataggttgaggaagataaggattgaggattaactcttgtgtatttgcaaaacagaagtcactgatgcccttgagaagagtggttttagtggaggagtgggaacaaaagcctgactagaggttttcaagaaaatagagttcatataatttgttagtgtttttttttactgtgcaagtgagcaaccaaatgcggagataggaagacagtggggacaatgagtccatgaacttggcacatgtgtgcacttgtgttaaagatagagctattaccaatgaaaataatctattaaaaagtacagtgcagacaaaacaggagagagaatggacacacctgcacagtaagagaaaagtcctttcttaggttggtagaggaaattagatcctccagacagtggtaattaaccagagagaaggtccaggataggtggaagtttgcggatgagaaagatgtatcggagctttgaggataaagagaatgtatgaaggattcctttgaaaagtaatagtgtgaattaagtggcaaaatggcatacagttatacagttattgcatagggatgatggaccacttgatgtttgttttttcttttattttccagccacatgaagctgttggcatgtaggattagagtagacaaactactatttttattttttttatgtttagttttctttataatacacttcttcaagtttaccaattaaaatattttgaatctcataattaagtcttaaatatacgtgttcatgggtggtaattacttaaaacacttggatagtagcaagcaatgaaacttctctttctcttctgttgtattcaccaccactttagcctgaataactgagcaaataccaggttcttggaacactggcataaactatgtatctaggactatggctctgtccatcagcacaagccactagtaattcagaaattggtcatttatataatggcatttattgcatctttaccacgaacaatatgattttttaaacatggtttaaactatattatacaaataattcagctgtgtttgatacttcttatatgtaagaatcactttcctttttataggttacttttcctctttttataatatctgaaatttaaggatgctgtctcagagagccctttatttatgcaggcaagataagaatctatctgagatactctcacattcttaaaaactaaatagctacccatgtgtgtgtgcatagtgatgtcagaagttcttaactgagtcgtaaattccaaagaatcttagctaaaatgaagctcatatcttgctaattcttctctgttaacccataagaaaacagaagcccagagaaattaaaagatttgttcaagatttgcttgatagcatactaaggtggatttaggactttgggctctgaattgcttaatatggaagtgttgctcagggaaaagcccaaaccccagcattacacaataaatccatgcaacaaatttatacatgcagcctctgaatctataatttaaaaatgtgcaaaaccaagcatctttgaggaacaaaattctgagatattataagactttgaaagtcatattaggctttgctattgttcagattttttaaatatttttaatttttttcatttaaattttaagattttgttgtggtaaaatgtacataacatataatgtaccattttagccattttaagtttacagtttagtggctttaaggacattcacattgttgtgtagccatcaccaccatccatcttcagaacttttcatcgttacaaactggaactctatccattaaataggtgctccccattaagccctgctccccgcccctggtaaccattattctatgttatttctctattaatttgactattctgggtatggtatatttgtgaaatgatatgaaatttgtgctttcaatggacaagcatttgaggggattcaaaattgaattattttatcacgtttcagatggaactacaattattgagcatcaccattttagacattttactaggaaccttaaatacatgttttattttaaattctggatcaaaattctgaactaattgatttcatttctttataaattggacagaagctgagcatgagaggttaggtagccctctcaaagtcaaacattagaggcaagactagaagtggaatcttcaaacccatgtccattaacatttcacagaactttgaagtacattatgcttgcagtgattaaagcttgcgatcaagtgtctgactaacctgagttgcaatcctgactctgcctcttacatgctacaatattttgggcagttttctgaacttttcaaaccctcagtttttcctttgcaaaatgttaaaatgatagtttgaaaatcatctagaaagggtgttgattatagcatagcacaagacagaaacttttccatatcataaagaaaaaaatataggctttttgagatactaagaagattatcatttatatctgaaagggaattcagattgcttagggaaattatacctaagatgagactcacaatggcagataataataaaatagcgatatttttcacatattaaaatgcatgtgttattgtatataacaattatatatttaaaaattgtccttcagatatactcaaacacgtcttcaaataccttcatataaggatatttactgaagtatgatttgtaatacgaagaggttgtaaacaattagaatgtacagcaataaaggatacaataggttaaagaaaaaatgtattgtaggtatagaatatttgctatgtacctaattttttaaaatcatatttataaactaaaatagatactctaggatatgtcaaggagctaaggaaatcatttagtttactatttggatgtttacactgaatcttcaaagtgttacattttcttaaaagaaaatgttaaagcatatgtggcatttagtcaaatgtatatgaatatgtatttatggcctctttatgtaaatgcatatatgagatgttcttgaagtaaaaaataattctgtgtttttttctcttgacacaagttgaagctattacaaaagctaattatttaattaaaataacactggaaaaaatgttttaaatttcatttgttaagctagaaaatatttaagaagggaggaaataatttagatcaataccatgtgtatatttaaatcagattttcaaagtttgacctttttacagaaaatctaacagcaacaatcatttccagcgttactccaggtcaaatcatttgatagtgttatttcctatagtagtgtgtattagaatagaatgtctgaaaacttaggctacactaaatttataaaatgcattttttaaatagtaaactaactttagcttactgttgtttttaataaaatttttaatttttaacttttttagctttttgactcttgaacacatggtatagccatacaacatagtttctttctttatatttttattctataacctttttctattttaaaaattattaatttaatttttacttttaaagcattttttaaacctagacccaaaaatacacattagcctaggcctacaccgggtcaagataatcaatatccctgtcttcctcctccatatcttgtcccagtacaagactctgagaggcaataacatgcacggagctgtcatctcctatgataataatgccttcttctggaatatctcttgaagaacctgtctgagggtggtttacagttaatttttttataaggagatgaagtacactctaaaataacaataaaacttacagtattgtaaatacataaattagtaatataatcatttgctatcgttttcaagtactatatactaagtgtatgtgctattatttttatcactggcagcacagtaggtttgtttataccagaatcaccacaaacgtgtgagtaatgctttctgagatgatgttacaagggctatatcaccaggaaatagaaatagaaatttttcagctatgttatagccttatgggaccaccattgtatatgttgtacattgttgaccaaaatgccattatgcagagcatgaccatacaaatgtacagatgctcatcaaattacaatgaggatacatcctgttaaaatcattgaagtcaaaaatattgtaagttaaaatgcatttaataaactctgtctactgaacatcatagcttagcttagcctaccttaaccatgctcagaacacttgcattagcttacagttgggcaaaatcatctaatacaaagttaatttttataatagtgttgaatatagtatgtgactgattgaactgcactgaagtaaagtttccactgaatgcatatcacttggcaccatcataaatccaaaaaattgtaaattgaaccactgtaagttggcgactctctgtatataaaatatgtgtgtgtgtgtttatgtattttaaatcatcactgcctctacttttctaatttttgcatggaaatccaaatccaagggagcaagacagccaattttttttttttttttttgtatttttagtagagacggagtttcaccatgttggtcaggctagtcttgtactcctgacctcgtgatcagcctccccaagtgctgggattacaggtgtgagccaccgcactcggccaagatagccaattttaattataacccagagctaaaaatgtctagaaaattaaaatcatcagctaataaccaaactattatataaatatagattattttctagaaaagaaaagttcaaaggccatttaatagttgaaattttatgatgggtgcaaattttgatgcactatgttttgctttagatcctttttaaagaaagcattaaataaggaatgctttacagagttattgagattttttagcaaaaagaagtcctcattatttttgttttggtttcctgtgcttttggtgtcatatccataaaatcattgctgagacgaacatcatgaagcttttccctcatatttctttttgcactttaatgatttgagtcttacatttacgtcaataacctattttgaattttttgtgtgtatggtgtaaaattgtgtccaataccattcttttttatattcttatctatttttccaccaccatgtgttgattaggtcattgtgactttttggcacccttagtgaagatcagttgactatatatacatagatttatttctgagttctgtatcatattccagtattctatatgtctgttgtacaagtggtactatatcaaactaaaaaggctctgtacagcaaaggaaacaacagagtgaagaggcattttgccttaacagaatgggagaaaatatttgcaaaatgtatatttgataaaggtttgatctccaaaatactttatttttgaaactcctgtaactcaataaagcatgtgacttgattttaaaaatgggctaaagacttggaaagacaattttccccaaaagaactataaatagccaatagatatatttaaaaatgttcaatgtccctaatgataagaagaatgcaaatcaaagtcaacaagagatatctcctcacacctgtcagtatggctattacaaaacaaaaacaaagaaatcaaaacaataaaaccccaaagacagtatgtttttagtaagaatgtggagaaagtggaactcttgaaaactgttggtgggaatgcaaaatggtgcagccactatagaaatcactacggaggtttctaaaaaaatttaaaaatggaactaccatatgattcagtaatcaaaattcttggcatttatccaaaagaatcaaaattacactctcagatacaatcatatactagtactcttatgctcattgcgactctatttacaatatccaagatgtggaaacaacctaaatgtccatcaacaagtacatgaataaaaaaatgtgctacatatataatatatactgactaaaactctctcctttgaccaaaactttatttggactcttttgaatcttatgcttggctaggtctaaccttgggcttctctttctgtccttgttgaatccagtttgagcaagattcctgttaagtcagcttaggaaaaaagcttcaatatcttatgacactggactccattcagcaataattccatcaagttgatgtagctagaaacctcgtttttctgtatgtttcctcttagtaattttccattcactgaaccccaccctgctttttggtataagtctccacttgtcatggtggaagtcagaattgagtccaatctctctctgctcctttaagaccactttgctggggtccctatacctattaccatgcccatccttgaacaatatctgccttaacatctttaagaaaattctgcaatatataatacaatgttgtatggcagaaagtttcagtcaagccaggtaaaaaagccctagagatctgccaaacaacattatgtctatagtcaaagattatacacttaaaaattggttaagaggataggtctcacgttaagcattctaaccacaataaaataaaattaaaaaaatttaaaaaagtcttcactagcattaaaaattattaattataaatttattacagagctgtcctcaattaaattaaaaaataaaattgtcagcccaatgaaggcattatcttaaaaattagaattaatgtgcaaagagtagaataatgggagtggtaaaaattgaagttataaaagttatgttctaccctcaaccatcccattagttaggtaggctgggtaagtcatttttttttctctaagcctcaattgtacttctttagacttgggctaatcatactaaacaaatgggattgctattatgttaaaacacagacattaacaaacagcagttcaatctgactctggctaactatatactgaatagaatgcttaatgtattttaaccattctcacagaagtagaataaacaatataaacaataaatttccgaatccaaagtttaagagatgttaaggcaaatactgtattgtctgaaaagtatacacttttgaaaaatacataggattaatattgaaaatatcagaatatgcttaaacaagtatgcttacataggttttctcctttcatctcagtttgaaaatctagccatgtaaaatcagtttctagttaccagtgattcacagataagcttcacccattaaaatttccattcctacttaagaatcacaaagaagttaaaccccaaaagcagcatctcaaaatcaactctgaaaggcaattactttttcaataagtaaaattcatgaggaaaatttgtcactgcattagcaagttgtctctccatagaataaagaaccaaagctttacttgttcattgtgtatgagaagatcaggatcagtcagttaatgcttgtgttgagaacatttataatgtcaaaataaggttaataatcctaaaaattagataacttaataaagcaacattagactacctaaaaattccaatgctcaaaaagtaattcaatatttttagatatgctaaattgggtatctgctttctcagtaacgtttccaaaatacctatcttctcttcacattcaatttttctttcttactacaactctttagccacaactacataaaccttaaaataaaattttctgatattattattaatatatatgtccacataggtagataaaatggctataaaataggtaatttttaaagtttatgagctaagtgatgctaacagaagcaattctacaaatacatatgcaaagtgtattattcatttaaaacaattaacacaaagcactcttttttggatatggtaactaccaaagtcaaaaaaacaaagagctgaaatattatgtaaattgttcacagaaactgttgatctccaaaccagtcaattattatcacggcttgaatgttatataaaatggtagaaaaattcttgatcaacacttacattttgcctctgactactttcctcattaacttaccagccatgaaaagcactgtgcaaaagtcagcaattagggactgaataaagttttaagtggatcaatataacatatttggcatatctatgacacttctattaacattcatcaatttatgaaataacgacattaagtaattgtgttcatcccaaaaacccaaatatcaaatactatttgcatgactgtgttatacatagagcagaaggcagtgaagacatgatctttgcttttgtcacctatgaagacaaatatattgagtcacctatgaatacaatatattggagtgtgctctataagacaagtagatgccaactcctactggtcttggagaaaatgtaaataattctattggatgggagcagcaaagtaggtagcaatttcacagaatgggtggtattggggcatgttcttgaaggaatgagaggtcatcaaacagacaaaaacgttttgaacataggttataagcaataaagaaactgtggagttgcaaaaaatacagcatgatcaagaaattgtatagtcatgtgccacttaacaatgtttctgttaataatggaccacatatatgaggtgatcccttaagattggaatggagctgaaaaatgtctatcttctgttgacactgtagctgtcataacattataacacaacgcattactcatgtgtttgtggtaatgctggtgttaacctactgcactgccagtgtataaaaatacagcatatgcaattatatatagtacataatactcaataatgttaataaacaccatattactggtttgtgtatttacaagactaccttttttttttttttttttgagatggagtcttgctctgttgccaggctgggctggagtgcagtggcaccatctcggctcactgtaacgtctgcctcctgagttcaagtgattctcctgcctcagtctcccgagtagctgggactacaggagcacgccaccacttccagctaatttttgtatttttagtagagatggggtttcaccatgttggccaggcttgtctcgatctcctgaccttgtgatccacccacctcaacttcccaaagtgctgggattacaggcatgagccaccatggccagccacaagactatattttttatagttattttagagtatacttctcctacttattaaccagagtatttgaattttgcattttaagctgtggggagttgctaaaccagtaataactataataagaatatcaactaacgtttgtcagtactgttaatatcattcaccaacttttaaaatcacctattatatttgaaactgtttattatctcagtgtccctagaaaagcaagtactgcattaggtgcataagaagatgaccatcattgaaggtcaatgagcaaaatgtccaatttttttctcaacttggctgaatatgagacagaggagttcctctgagcaggtgagttatgtagcttatgacttacaaatgatccctaaaaacttcttatatggtatggtgtaaatgaaagtacaaaataatttatgacagtacgtagcagaacaaaagaggaaaatatgttttaattatcaattaaaaattacctccaaacttcaaatatgaaaacccacaaataaattgcatctctattgaaatagcacaggcacttcatggtttagatttgtagaaatgtctctgaaaactctgtatttcctacttttatgtttgtttatatttaggagcagcctacacataatttggctcacttaaaagactttcttaatgagtagtaatctacatagttccttgctgctttattttttagattgggctggggaagtcaataaccactagaaactctcaaaccaagaaattctcctgaagcaatctttcagctgtaaaccacctcagctaggaacccattgtattcctataaatttccttcagtattcctaagactaaactaatctgaacctcatgactgacaatgagttgagaatgaccttttgcaccagtgcattaattgtgaaagctttctgcagcaggagctaggaaattactcttctgagtacagcagccagagcactgaaatggctctggctgctgtactcagaggagtattttgaatggcaatgcttaactcttcagccacacatcgtctacatttttatattttacagacattttagatgtgtccatcatcctccaaggaaattggatttctgaataagaaatttcttttcaccctgtgatttctacatgatacttatagaaacagtttgacagctttggagaggatatcctatgcttcatgtagactttctgcttacggagtttaacacactcataaatttagctttactgactttacaatcttttatatgagaacagaaaagtcagcaaatttggaaatagaaagtttatgttccgccacatataaagtatgccaagtaatactttggccacttcacaaggaagaaaaggatatatatccaaatttatataacattcaagaaaatctttaattatattccagagctgataatttaaaatttatcttcaataattttatttgtttccaaactacctgctgctgagaggaaaataagaatatgcaatttgaaggcatggcttgtagtgtatcatagctctatttattatattattatattcatctacatacactgaactgaaattgtagagttcatttatcatttagatcaacttttaagaagatatatttccaattcttacctgtccatctcaaattgagctcactatattcactttatgtataaatggtatgtatacataagcaaaatataaatacaagcagtgatatatttattgcactttgtatcttaaactagtatacgtttgcttccagcagtattttgattttactgcaattcagatattctgattatcttttacctaaactttaacaatcaaaacaacttatcagtcatctaactttaaacttcctctgaaatcatagtctttgtacacgaaatctaactggggttaaatgttcttcttgttctctctgattgagccttccctgggacatctcatgcatagaaaagagttcacaaataaaaatcggttagagctgtgattcagtttacataagatctagaaatataagttccataacttctaaacgaagtcatatccttaagccattcttaaacttaaaagcgaataactccaaacatccctgattgaataactcaaaataataagctcatcaatctgataggaatgtcaatctcagatacattgccaagaaaatgaaaatgatgtagtaaagattaaatgagaaaatgatgccacatacttagcataaatgcaaacacaaaataaatactcaagtaaataaaaccattctttttttaaatgtattctaaaacaacaacaataacaacaacaaccacaacaacaaaacaggatacaggtgcagaacgtgcaggttcgttacataggtatacgtgtgccatggtggattgctgcacctatgacctgtcctccaagttccctcccctcataccctaccccgcaacaggccctcgtgtgtattgttcccctctctctgtctatgtgttctcattgtagagtaactcccacttatgagtgagaacatgtggtatttggttttctgttcctgtgtcagccataaaaagaaataaaaccattcttaggatgatatttctccttacccttctctttttacaccgagaagaattatcactttgacaactgacgctctctttctttctttcctgaaagtaagttacactgtaacttatatgagtaaatgagccctttatatgaagcttaacatttaaattctaaaggattcttaaacacatgtgtaacaacaccatgtgttagttaatcctatcataatatatcatgttcatatattagattaatacaattaatcacattctaaattgacaacattttctgagatcttggtttcttaatatttgcagtagaaacaaatattttttctcacccttgagaattaaaagtgaagcagaaactttagagtcatgttaagttgctgactatctaacttggtttctgaatgataaagtagactctaatggtgattgctttttcagtaacaactttcagtaatatttgtatttttctatcacacctttccctgaagaagaaatgctttcagatgaatagggaaagactctctaagtataggtttgagttttagaattggctagattggagagttttagatggaagagggaggtatcaatcaagtacagaagttaatgctacaataattacttgggaaaattctcacacttcagtgattgccaatcagcctgcactacttactgagtgaaatgtctatggttatcagaaatcgtacaagaaaaaaccaaaccgaaacaaaaaatagtgtagttctttttttctcaacgaagtatatttaagagcattaatttagatccaactaggcctaggtttgagcacaggattttccactgtgattaacttaaactctcttgtttgaagttgtctcacctataaaatttgggacaattgtggtaattccagaatgaaaataaaatgatgtacatacatcatttagtatattaaaaattctcaataagaattgatttttctgttaatacgattataatataatttgaggctacaactaaagaatgaaatgaatagaaatgtaaacagaatggtcacttttgaaagggcttattctgtttagaagaatgtatagacatgatcaaataaatgttcagataaatttatagagatgtcaaataataactgcaaattgtgcaattcaactaaaatgtcgagagacaatgagacaaataccttttttattcaagttttaagaaaaattactgaagtttagaaaatctatggaataaatagaacaatacaggcataccttgttttgctgctctttgctttatttcactccacaaatattccaatttttacaaattgaagttttgtggcaacctggtgtccaacaaatctatcggcattgtttttccaatagcatgtgctcacttcatgtctctgtgtctatgttttggaaattatcataatatttcaaactttattattattattatttgttatagagatcagcggtctttgagatcaactactattgtagttgatttgggccaccacaaaccaggtccatagaagatgataaacttaactgatacatgttgaatgtgttatgactgctccacccacttcagcttccctgtttccagaggcacacaatattcaaattaggccaactaataattgtacagtggtctctaagtgttcaaatgaaaggaggagtcccaggcctctcatttttaatcacaagctaaaaataaataagcttagtgagaaaggcatgttgaaagcccagaggccaaaagctaggcctcaagcaccaaacagccaacttgtgaatgcaaaggaaaagttcttgagggaaactcaaaaagtgctacttcagtgagcacatgaatgataagaaaacaaaacagtcacacaccagggcctgttgtggggtagggggagggggagggggaagggataacattaggagatataactaatgttaaatgatgagttaatgggtgcagcacaccaacatggcacacgtatacatatgtaacaaacctgcacgttgtgcacatgtaccctaaaacttaaagtataaacaaaacaaaacaaaacagtctgattgtggatatagagaaagtgttactggtttggatagaaaatcaaaccaaccacaacattcccttaaaccaaagcctaatccagaacaaggccttaactctcttaaattctgtgaaaactgagagaggacaggaagctgcagatgtttgaagttagcagaggttgtttataacatttaatgaaagaagtcatctccataacataaaagtgtaagatgaagtagcaagtgttaatgggtaagctatagcaacttatctggaaaatttagctaagatcattgttgaaggtggctacactgaacaagagatttttaatatagatgaaaataccttctatggaaggatgccgtgtaaaactttcataactagagagaagtcaatgcctggcttcaaagcatcaaagtacaggctgactatcttgttatggatgaatgtaggtggtgactttaagttgaggctgatacttactgaccattctgaaaatcggagggttgttaagattatgccaagtctactataactgtgctctatgaatggaataacaaagcctggataacagcccatatatttacaagatagatatgaatattaattttttccattggggcttcaaatgaatatttaagccccaatggaaaaaaaaagattattttcaaagtatcactgctcattgacaatgcacctagtcacccataagctctgatggagatgtacagggagatcagtgttgctgtgatgcctgccagcacaacatccattctacagcccatggatcaaggagtaattttgacattcaagttttattatttaagaaatacatttcacaagactatagctggcataggtagcaattcttcttatgtatctgggcaaagtaaattgaagaccttccattctagatgccattaagaacatttataaattataggaggagatcaaataacaactttatcaggagtttggaagaagttgattccaacactcatgaatgacttcgagaggttaagacttcagtgtagataatacctacagatgtggtagaaattgcaagggaactagaattagaagtggagcctaaatatatgactgaattgctgcaatctcatgataaaatatacacaaatgagcaactgttttgtgtggatgaatacaaaaaaagtggtttcttgagataaaatctattcctggtgaagatgccatgaactccattgaaatgacaacaaagaatttagaatattacataagtttagttgacaaagcagtggcaggttttgagaggactgactcccattttgaaaacatttctactgagggttaaatgctatcaaacagcactgaaatctatggggaaatctttcatgaaagaagaaaagtagcactggcagttgaaagttaaaagcttcccatttctgatcaaaaagattctttcaaatcagaaaataaatgaaaaaaaaaaccgccctatttttgtattttaatttccaccctaaatttctacttcgagctttattttagcatgcccattccttaggtttccttttgttttgaataatacttccatagctatcctgaaaacttttaacaagttaaagtaaaatgatgtgattataagttaagtcattgcagggatggatgtttttatctatgtatgtgtatttttccccaacatctcccctgaccatcaggctgtcatcttataggatacagtggaaatttacgtttcttttagagatggtgtatcactatgttgcccagactggactcagattcctggggatcaagcactccttggcctcctgtgtagctgggattacaaatgcacatcactgaacccagctagtgccaatttttgaagatattattgttattatgtctttgcagaaataaagttattttatttatttgtagttactacagaagaaatgactttgatagataaaaaatagtaacaaatttcaaatagaatggaaagagtaaattatctaaaatatcagaaataacttgttttagcttatatatacttgatagtttaaaaaatatttttctctcaaagtagcatactatatttctgttgtgaaattatttagttcacatatcatgatcttttaaacttattttatttacaggtatatctgcatataaatttaaatcttcatgttgaaaatacatgattacctgagaacacagtttaatttatttaaaacagttacattatgttagacttatattttgtttttattttttcattatgtatatcgctatgcttattgaaatgtgtgtatatatatatatatatatacctctttacatgcttgcaatagttaacctctgcagaaatgtttatgcttatttttgcttattccatttatggtcagagagagagagagaaaaggaaggaaggaaggaaggaaggaaggaaggaaggggaagggggaaggggaagggaggaagggaggaagggaggaagggagggaggaagggaggaaggaagtaaggaagaggcaaggaaggcaaggaaggccggcaggaaggaagaaaagcaggaagggatggagggagagtgaaaaaaagaaaaagaaaagaaaaaatagccaggaagactgttcttacataaaaacgttctcacctattggttatttcttactctaacaggcacttacgatactatttaggccacctgctaagttctgtatacagtggcatctgtacattcccttcttatcattggtagagagactcctaaatcaatactcatcctgagagtgagctttaatatagtatgggtggtatttataagtaatgaagcagtcaagaggagaaacaagtccatgtttatctgaaatgactatcttctcattcaatgcagttacagccacctacagaaagggaaaatcatccaaacagaatttaagaaagaaagtttacattcgcttgactggaaatcacaggcaaattgctttgttggcatgggataaatgaaagttaaacacgtttggatattaggagagacaagctaatttgaagtattggaattaaaaaattaagtacatagatttcttgaaacaatcactcacagatacagtgacatgggtttgctcaaagaatagagaagactggcacattttgacagaatgttgccttgggtttattatttgcatcagatctgctcaatagtttagtgctgtatagattctgtgtttagaaggattccgagggtgtctgttgctgagcagagaaaaagctacacactatttgctatatcagccaggggaaatggaatgagatgagatatttgtcattcatgtggtagtgcaaagatctgcagctgtgctgccttacagaacctggttttccaccctctacatcatttcaaaactatataaatttgatcaattacttaacctttttaattctctattttcaattttatcacttgtaaaatgaagataataacagctaccctgattacctacagtgaatttagaggtcatagataaatgttctaacattatgcctggcacatgatagccaacatttacctagtgccttctattatcatgatttcttccctgacaactgagccactttttatctttagaaggcaccattttttaactattgccagtgtcatttgtgtaaaagtttcttagtaaagcagtctttgataatgattatgacttttctgtgtcctcaagaagggttccttgacttatataataaattcttctttgtctttcacatttaaaagggaaagtcaatattaatcaaatgagtgtgttcataaaagtaatgtcctcctcttcggaagaggaaaaacagcattggtttacccaaaatctgtttctgtgcttagaataaagatctagtgtctgaaatcataatggcattctaacaaaggattaaacaaataacttcagaaaacataatacaccttaatgatatttcaaagtatttatcaatgttattgtcaactttgaaaggtgagaattttgtaacatgatttgacaatgcttaactacaggttttatgtaaaaaaaaaactagtcacttacatgttcctcaaattattagttcatatgttacggaagaaaatgtttgccacatttctgaataaaagtcatcaaaatattgtgatctagatgtcatgtaaactgaattaccaagaccctatcttaagtgactctatcaagacccataaccagaagtaacaaaatctctgaaggaaaggatttctgcatgttttcaatatgacagaaaattattttttattgttctatgatgataatgatggcaatgcagtcccacctcacttttgaaaccagacttcagtgtttctctgaatacttttaagtgtggccaacagcaaagtggctgaagtagtaggattgaagactgttagccttaaggacaaaaatggtaatataattttcatcatactataattttacctaatattccttatattgaatgtcaggagaaatatattcatatatattatttccattaatgcattttaataacatatttagaatgttacattatttagcatctcagtagcaataaatagttttttatttctttatctttttaacactttgtaaagaaaatacattttactggtaagttatgcattgcataggggaaaacaaatggacaaaatgaacatatgaaaatcagctatgccttaatgattatattttatgtattttaaatatagtattcctaaatctattttacaaatgatgctcagtaaaatccttaacctctccattgcagcaggttcccagcatgaaggggctaaactaacaaagctaggggcctggcattagccccccagagttactgcaagcaggcctggagtactaaactaatctttggccccctgagatcttccagagacaaagtcaatcgactgaacccaccatattcctctatcaaactcccaagggaatcaaagaagataaaagcaaataccttatccaaagggcagcaacttccaagattgaaggaacatctgcccacacagattagaatgtaccagcatgagaactctggacgctaaaaaatccagggtgatcatcctccagatgatcatgctagttccccagcaatggttcttaaccaggctgaaatgaccgaaatgccagaaacagaattaagaatattgatagggatgaagattactgagattcaagagaaactcaaaacccaatccaaggagtctaaggaatacaatacaacaatacaagaactgaaagacaaaatagccattttaagaaaaaacaaagctgatctgatagagctgaaaaactcacttcaataatttcaaaatacaattgcaagtatcaacgcaaaatcaaccaagtggagcaaagaatctcagaggttaagtctggtactacaaattaattgtcatacaaaaataaagaaaaaagaataaagaatggacaaaacctttgagaactatgggattatgtaaaaagaccaaatctctggctccttggcatccctataggagaaagagtaagaaagaaagcaagttggaaaccatattttgggatataggccatgaaaattctccaacctcacccaagggccaacacttaaattcagaaaatacagagaacccctgtgagatactatacaaggtggccatccccaagaaatgtagccggaagattctcctaggtcaaaatgaaagaaaaaatgttaaatgctgctagaaagaggcagcaagtcacctacaaaggcaactacatcaggcaaacagtggatcttttagaagaaaccctaaaagcctgaagagattaggggcctatattcagtatattttttaagtgataatgcttcagatttcttcctacataattagaaaaaataatcacaacaaattggagaggaaatacaataaccttaaagataatctgggtcttatctaattccaaccaaaaatttcatatctagccaaactaagtttcataagtgaaagagattaagattcttttcagataagcaaatgttaaggaaatttgttagcacgtgacctgccttaaaagaggtccttaaaggagtgttaaatatggaaaggaaagactgttacaagacattataaaaacacactttagtacataaatcgacattctaaagcaactacacaatcaagtctgcataatggccagctaaaaacatgattaaaggatcatatctgcacatatcagtattaaccttgaatgtaaatgagctaaataacctaattaaaaggcatagagtggcatgctgaataaagaagaaagacccaactgtatgctgtcttcaagagaactatttcacaagcaatgacacacagaatctcaaattaaagggatggagaaaaatcaatcagacaaacagaaaagagaaaaaagcatgggttgctattttaatttaagaaaaaacagagtttaaacacacaagcaattaaaaagacaaagaagagcattacataattgtaaaagtttcaattcaacaagaaatcccagctatcctaaatatatacatgcccaacacaggggcatccagatttataaaacaagctcttagagacctacaaagagacttagataaccacacaccagtagtgggagacttccaacagcccactgacagtattagacagataatcaaggcagaaaattaacaaatatatttggaacctgaacttgacacttagccaaatggacctaacagacatagacagaactttccaccaaaaaacaacataatatacattcttctcatctgtacatgacacatactatataatcaaccacacaatcacccataagacaatcctcagcatatgcaacaaaattgaaatcataccaactgcactgtcagaccacagcacaataaaaatgtaaatcaatactaagaagatcactcaaaatcatacaaatacatcaaaatgaaaaaagctactcctggattacaatgtgggtaaacaatgagattaaggcagaaatcaaggaattatttgaaatgaataacaaagatacaacacatcagaatctctaggacacagctaaagcagtgttaaacaaaaataaacaaaccctaaagctagcagaagacaacaaaaaaccagagtcagatctgaactgaatgaaataaattaagacctgaaaaccatacaaaagatcaacaaatttagtggttgtttctttgaaaaaataaataagattgataagtaggctactgaaaaataaaggtctgaatatccacaatcagaaatgacaaaggggacattacttccaattccacagaaatacaaaaaaaaaaaaaaaccttcaagtaatattacaaacatgtctatgcacacaaactagaaaacctagaaaaactgataaattcctggaaatacaaccttgcaagattgaactaggaagaaattgcaaccctgaacagagaaataatgagttccaaaattaaataagtaatacaacgcctaccaaccagcaaaaggcttggaccagatatatccacagctgaattctaccagatgtataaagaagagctgcatcatttctgctgaaactattccaaaaacattgagaaggagcaactcctcctcactgattctatgagtcatgcatcattctgatatcaaaacctggcagaacacaacaacaataacaacaaaagaaaacttcaagccagtattcttgatggacataaatccaaaaatcctcagaaacaaacaaacaaacaaaaactagcaaaccaaatccagcagcattctaaaagctcattcaccatgatcaagtaggctttatccctgtgatgcaaggttggttcaacatatgcaaagttagtaaatatgattcaccacatcaacataattcacaacaaatccacatgatcatctcaatagatgcagaaaagtctgttgataaaattcagcagcccttgaggttaaaaacctccaccaaataaggcattgagtaaacataccacaaaatagtaagagccgtctatgacaaacccaccggaaatatcatactgaatgagcaaaagcaggaagtgtcccctgctgagaaccagaggaagaaaagaatgcccactcctaccattcctatttaacatagtacttcaagtcctagccagagcaataaggcaagggaaaaaaaataaaaatatacaaataggaagagaggaagtcaaactgtctctatgtgcagattatatgattctatatgtaggaaaccccatagtctctgcccaaaagcacctagatctgataaacaaattcagaaaagttttagaatacaaaatcaatgtacaaaaatcagtagcatttctatacactaacaacatccaagatgagagccaaatcaagaaggtaattgctttcacaatagtcacaaaaacgtaaaatacctaaaaatatagttaaccagggaggcaaaaggtacctataatgagaattacaaaacattgaggaaataaatcagaaataacataacgggaaaaacattccatactcatatatagcaagaatcaatactgtaaaaagtgcaatacttcccaaagcaatttaaaagaacaaagctggaggcatcacattacctaacttcaaactacagtgtaaggctgcaataaccaaaacagcatggtattggtaaaaaagcagacacatagaccaatgggacagaatagacaacccagaaataaagccacacacccctacaaccatctgctcttagacaaaattgacaaacaagcaatggtgaaacaattcagtgttcaacaaatggagctggggtaactggctagccatgtgcagaagattgaaattggactcattctattcaccacatacaaaaatcaactcaagatgaattaaatacttcaatataaaactcaaaactttagaaaccctagaagataacccaagaaataccattctggacataggcaaaattttacaatgaagatgccaaaagcaattgcaaccaaaacaaaaattgacaaccgggacataatttaactaaagaacttctgcatagtacatgaaactatcaagtgtaaacagactttgatagtttgaacttctgcatagtacatgaaactatcaagtgtaaacagactttgatagtgtaaacctacagaatgggagagaatatttgcaaattgtgcctctgacaaaggtctaatatccggaatttctaaggaacttaaattaagaagcaaaacaaacaaacaaaaaccacacaaataaacaacccattaaaaactgggcaaaagacatgcagagacactttcagaaagaagacatacatgcagctaacaagcatgtgaaaaacgctcattatcactaattattagagaaatgtgaataaaaatcacaatgagataccatcttacatcaatcagaatggttattattaaaaagtcaaaataacagatgcctgcatggttgcaaagaaaaggaacacttataccttgctggtgggaatgtaagttgattaagccattgtggaaagcagtttggagatttctcaaaaaacttaaaacagaactaccatttggttcaacaatcccattaattgagcacattcccaaagaaatataaatcattctaccataaaggcacatgcatgagtatgttcattgtagcactattcacaatatcaaagacatggaatcaatcaaaatgcccatcagtagtggactggataaagaaaatgcagcacttatgcagcatgtcatattacacagccataaaaacagaacaagattatgtcctttgcaacaacattgatgaatgtcattgttctaagtgaactaatgaaggaacagaaaaccaaacactgcatgttctcacttataagtaggagctaaactttgagtactcatggacacaaataagggattcagagacactgatgcctacttgagagtttagggtaaggattgaaaaactacttatcagctactataattattaccttgggtatgaaataatctgtacattgcacccccatgacacctaatttacttatataacaaacctgcatgtgtacctatgaacctaaaataattaaaaaaaatacatgctaagattaatccatatcagttatttccagaactgtcatttgaatgtggtagagatataattaatataattgaaagaatagttagaatgcctgggttcaaattatggctccatcacttgttagatatgcaattttgtgcagtttatctcatctccccaaacctcaatttcatcacatataaaatattttaagcgtaatatttcataggttgtacttcttgatctataatcagtttttacaaccttttgaatttgtttatgacataagtgaccatagcaccactattatccataccatgagttgttctacaaaaagtgcatagagaccattttcttctagaacagtgatttgactataatagattatcatgaacattttaagctttatctgatttgaagaatatttactttctcaaatattacttaatatttactggctcttggtcaggtggcatggattcacattttgattctatcattcactactgcataagtctgatagttttactcaaattataggtgattatagacaggtatctgatgatggatttttttcaaaaatttctgaacagtattgatagatgtggtatcaacggtacagtgaaacttgccatttctctttctcagagagtggagattaggcatcttaaaaagagaagagcatattgagaggtaaacagcataattactcttaacagtgagccagatattttgaatgctcagatgtataaagctgagtctcatccaactaaatatgaatggttgtctgccttagcagagtattttaatcacattcatcacctccagagtaatgctgattacaaggaactccattaaaataaaatgcatttgatattccaaatagttttcatgatagtatggctgaaatatgtacatttaaattatctttaatatagaaaacaaactgatctttctaacttccaagtcaatacacaacttaccatccccacttttagctataactcaaccctagaaaagtactgttagaaatcaaatataaagtaaaaatgagtgtattgggtttcatgttatttagtcaattatagggctaataggcctataagaatttaaattgcattgaaaacttgaagaaatatgacatgcagagattatcctagtagataaaattccttagatggtatgggatagtaatataaatttttagaattatttccatgtttcctactttaagttttacacctaccatacctggagaataggatatgtaggtatttgaagacttaaccacaggaaatgggggcgaggaagacatattttaatttattttttcaatacggtgtctcgctctgttgcccaggctgtagtgcagtggcgcgatctcggctcattgcaacgtccgcctcccaggttcaaacgatcctcgtgcctcaacctcctgagtagctgggactaccagtgcatgccaccatgcccggctattttttgtatttttactagagacgggtttcaccatgtgggccaagctggtctcacactcctgaccttagtgatcttcccaccttggcctcccaaagtgctgggattacaggcatgagccatggcgcccagccagaaagacacattttaaatcttagaaaataagatgcaggaaatcctgttgagaacatagaagcaatcttcatgatgttatacagacctacttctctaatataattctaatagggtttacacatgttaatagtaagagatgtggaacactgtagctgtacttggtatactcctagaggctgacctctataggtaataaatgaaactggaccatggactacttacctaagctacagaacctagagtaaattgaggtggtaggcttgcctgatcagccccaaagaagggtcagagaaattaagtaagactcaactgacaaaatttgttgcaaactccagggacagtaaagtttcttaggaaaaatgagtagtacatcatgcaacagtaacttagtactatagataccactgttcttgcccaggtccatataaaattgagaggaaaggagtctaaataaatcatattttgatatattttccattggaagtaacttgctggtatagaaacttgaaatttgaaacaactacttctgtccagtttgccatttgcaacagctaccaagactttattctcagaagttacaaaaataacaaatggagactaaataaatacacaaataataaaataattaaaatagtaaaaataaagcagcatgtagatttaagattcctgaaaatacacagcctatctgactttttgaagcctgcatttatttcaaaataatacaaggtctttcaccagtaccaaaactgttttgggacagtattctgtgattctcacttcatgaaaaactggctatttcatttcaacaaacacacattacatgtttaccagacataatgcttagggttgagtatacaaagataaaaaaaaccacatgctggctgtttcatcaaatacatagaaacctaaaagaataaagaaacccataaagagatcattttaagaaggggaataaaggacatgatataaactcagagcaggactgcttagccccaatcactagattggtcatcacttttgggatggcataatttctaacataatctttaaatgcaggtaatgagttaagtaagtaaataagtcagagtttatcatgttttagcaacaggaaaagcatgagaaaatatatgcaattataaaataacatgcatatgttgtaggaactatattctatataattgtaacataaacatcaagttatgcatattagtggaaaaggctgtagaagcaggccaagaccacgacacagaggacatgttgtatgccatatggataatcacaatagagccagagacttgctaaatagaagtggaataaggccagttttttcttgtggataaatcactatggcaacattgcggatggtgaatttcaagagtgcaagataaaaagcaaaaggtcatggctcatatttggtattatatttgcatcaagtaaaatagactaacccaagttggactgtgacaaatatgctgaatcttacagagttgaatattttttatccagatgataaaacatataatgtattgaatggcaaaaattccatctatgtagatatatagaaaatgaagaaaatttttgattagacattatattacatagatcggacattagatctgacattctattacagcagccatgtgaattttgcagttacatggttttactgtttctctttgttttctctctttatagtcaggattttacctgagtatctagattatttctcagcttttattttacttaatctatagtgttggcctcctcttaggcctaaactgaactatttcaaatatctgactcctaattgtgcaaccttaaggctgtcagaatcaccccaatgcaggccagaataacgtgtgtgtgtgtgtgtgtgtgtgcgcgcgcgtgcgtgtggtcatctttattcttggcatgcttaaatagattttcataactgttccctcagataacgagcaataatagctctaatgatctctgaaaaaaaggaaacaaaatatcagaagcaaacatttgttttcattattttctcagaggagttttacaatttttatcgcttgagttagacatcatgttgtaaagtgagtgccttagttttagggaagaataattcaagattgactatcaaaacctgaccgtggatatttgctttaaattcttaccaccactgattatcttctttcattccaaagaaaaagaagagaaaaccaaacaattcattactatatggaacttacacctccctctgataagaaatcagttgctcaagcactgaaacaagatctttgcaaatgcattctttttagtatttgaaacttaatcacatcgtatagaaacagaattttatacgtaagtaaagaatactatgatcggttccaagattctccacttattcttggattgattgaagagagaaggaaatacacctactccatacattattatacattaatgaagaaatacacatttccttcaaaagttatactgcacaatctatttaagcctcagttttattttctgtaaatgaatatgaggataataatatcaataacaattgtaataatatctacttccattgttgttgtgaggatcaaatgacagggggtctttagtatatgcctggcacaaggaaacaaggaaacacacaagtcttagcaattacaaataattcatatatatatatatatacatatatatatatatataaaatcactttaaaacaattctaatacatattaatgtatagttatgggagtaatgtgtgtgtgtgtgtatatatatattatttatgcaggacatatctaaaatatatatattcataaatatatgtgcaggacatatcttaatatgtatataaaataaggcttacattgaatgagtcaataaacacagaatgaaagattgctgaacttatggttttactttaaccagatttttaggaattttccactcatgcaattgactaggataatgtatatgaatgtgtatatgtgtgtaagtgttttttaacacctttatgtatatatatattacatatttatatgtaatatatgtaataaatatgtactagacatgtaataaatatgtatatattacatatttagatgtgtcctgcatatatacttaaataaaaatataaatctgcatctatatacacatttaaatgtgtcctgcataaatgtagcaattcacaatgctactgacgtgatcctaccaagcaaacgtttgagtaatccttcttcctctaattgtattcattcagatcaatgcaatcagtcccactcaagtggacgatcatgcaatgattctttacaaaattggtaaatgaaacatcagttttcctagtgacaaaagcttgtatctaagggttttacaaacactgagaaatcaataaatagtgctggaaaagtattgtgaaggatattgttagtttcaaaattaatcatatttagtttaatattgtttaataatactgattagatttttactgtaggttaaatttctgagcgaagcatttctctctcaagactatgttgcccaccacacagttttagaatagcagtatattatgttattattagcctatttattttctactggctgctgcagaaaataaacacctctataatgaccacagtctagatttcagcctgtgtcaaaaggattttgaattatacttcatttttagcttttgctcccaccctttgcacaaagtagaagagacagaacagaaatgttttcctaattgctgttgcaagaaatacttcatctagaaaaaaatgaggaattaatttattttagcaggaaaaaatgaacaataaaaaatacatagagtgaaaagttgtagtcttctaatacctcttttttacttgatgactcaactttttgggaggtttctgggtctaccacctaattatttttactcaaattttattcctggaaggaagatggccatatgcagtaatttatggttcaaaccagaatacttttgagggtgagagcggtattgttaataataatgcagcaggcataaaccggattgctttgggaaaaccagtatatatgatcacctgtatataagggactacaatttcagtacttgacagcatggcaacactctatttagcaatgttttaggtttatttaatggtcacttcccttgccatgtggtaattacatctgctaaaagggtaagaggctgcttgctgtcacaactcaggctattcacatacttaatagacctgaacaaatactcagaagagtttcattgaatagctgtgtgtaccattgagataatctatcatttaacgtttcaaacaaaaatgatatctttcctctgatacttcaagtcattgcaacatatcagtaaaacagcattaaggaagtgttgataacatatcttttgaatgctgataatgtgactaggtctagtgacatctttcatatatttaatctgacaaacatgaacatacaacacttgaaaataagaggacttcttgatttatagggagtatattgtcactatgagttttttcatgccatagatatccattcctagggcaaaacaataaggacaacgtacaaaatcaaatctgctcatgtatcacatggatgaaaactaaggaatcatagaattctgagtaggtatagaccttaaagttcattctattttccaacattttattaaaaataatcacctttataatatccataatttatgagtatatttttctgactataaatgtccaaaaatgtcgataaattcctcaaaagaaagcccagttgaaaatatacaggagtttattcattcaaccttaatttgaaaaactaataaaagttattatttttttaaaccttacttctaatgtcttgaacaatgctgtagagtttactcagattttaaaattataatccttaagtagtgggactaagcaaacctgtattaaaccattttgcaatgtataatatcttctatttctataattatcatggattaacttccagatatgtcataagtaattgtattgagatttgtataatgtttaattgcttctgagttttctgcctttgattatacaaatgaatattacacatccttaaattctgaaatacttacaggtatttctcgtatatacgtagtagtgtaatttgttccctgaggcactcctaaatttgaatgtaaagagtatagaaattactttttccctttacaaggtacaatttaattatcaattcttttcctttacttaatcttcaaagtttcaaaaagggagagacaaagaaaatctattgtcagtagaaaaatgaatatttaaaaaagcagaaaacatcattgggtagttaggctaaaagaaataatctgttctccaagttcaaacaaagcatttcgaaattcattgttttaagcattaatttatattgctaaattttaaaagagatttaaaaaatcataacagctaagacacaacaagcagtagaagagacatatgaagaaatactacactgatggaagagacaatgatgaaaagaacatgtcatttgaagcaggattgtgataaggagagttttgaaaaagtttgagtgctatagaaaatgtctcatatttatagcagaggttagaaagaactcagatgtcaatgcaaataatggaattataggttgatgggtgcaccctgttctccagctggaaaaagtgtagttggggctttgggtgtacaaaactaagggggcagtaatttagttcatatagccacggaaaataacattctaaactagaattggaggctacatttagcaccccctaagatgatgagaagagctaaccaactgggttgaagattggtaccagtttaaactgaaacactagaaagaattaatcatcttatgagttatagcaagattcatgtcctaaattttaattatcataataattttaaacagatggatagtttggataaactttgaacttcactatgcagtaaaacagattttagtattccatgttttaaatagacctgtaagagatgtatgatagaaaacgttggcacagatgaaaattacgaagatagcttttaatttctacctcaaatttttaaaagattatctctttatgccataggtaatgggcatcataaatcactagctgcaaaagcaggtaagtgtgaacattccttcaatgccttggcataaatctagaacagttatttctttagactttatttcatagaattcattcaatttggcatgtgttcatagatgtggctgtttgtaactgaatgaagttaaaacacacacacacacacatacacacacacatacacacacagggcctgatttcaagtttttttacatttaatagtccacattaaagaaaatattcttcaacaaaattaaatttcaaaactccttacatgagtcattgtacaacttaatactgtgaacagacgcacgagaggaatatatttaggtaaataaaacttgtacaggttggagaacaatattctacctttcatagtagcaccgtagtgttgttcaaattgcagctttatgctaattagtgttgttctggctttttaaaacgtttaagaagtaacagtttaaataaattccgaattgattaagtagtcagtattccacagatcatggaagattttagaattctggatatatttccattcatctgtataatcagtgtctgggcaaataatcaatatgtctaaaatcttcatgacgaaacacttaaatatttcctgacaaagctctaagaacattttaatatatctggccatatgcctgtaaggttgtattacattttacaggtatcttatttatttaaaatttgaaaattgcgttttctaaatttactgaatttctttccctagacctgaaaaggcaaaacatgttttatcaaaaaggttaaatcctttcaccacaaactccattttgacttttcccttgataaacattgaagtaatattttattttgctttcacagaagaaccaaatggctcacattaattctgtgtcttatgtttatcaatgaaccaatagattgtgatgaacagaatcaaggctttgaagttgaaagtgtctctgactgatgctacttcacctctgtgagactcagttttcacatcagaaacactggccacgtagcagcccctttattcttcggttatattttctttcacaacttcacagttatacaggacttagaaagaacaatgtcagacagactaaagtgggacactgaactgtaatcagagaaggagatctctttttgagaaaggtgtcagatatcctgtgaagtgaactgtctatcgcaaacatcactggtgtctctaaacagctccaccagtcgcaactaaaagttagcctttttcagcagtgtagagatgagaagagagactgataggtaatatgaaataatagaacttacagcacgtattcagattgtatttgtgtccagtcgcaatgtataggttcatacatgtaaacttcaaacacatatgtacagtttaagcttcactctttatcctcattaggattcaacaaaactgttttgtaaaaaggccttaaacattcaattaatagcagtataatctaattccaatataggaatcataactttcaaaaagatccatttgattcaatttttctaaagtacataataaaagtcatcttataggcttcttacatatcttaggatatcttttagagtcatagtgaattggcttcattaactggtcttgaggtttgggaagttaagttcttcaagcccatggctaatagatttaacattcaagaccatccatttgatatattttcaaacttcacaggactcctgtttttattcccaaactataaccttttgaggtcaaaaataaaactttttaaatcttcatgtattctattcacttaatgttataatttttataacttctatctttgtggtataaacaaatatattcaagtgtgaaaaattttaacatcatgttgtgtggtaaatttatttacattcagttttggggtagaaagtgtattcttaaaaagtttaaaaccaactgttttcatgattaagctaatagaaattattaagcacatatttgtttgccaagagaaatattgagattgctgatactcatttttttttctccaagagtaaactatagtgagttccacaaatgcagtaaatatatctgttttagttcaccactatatttcaagtgcaatgctcggtttagacttaaaataattttccttatgcaaggtaactgactatatagaaattatttgaatagagtttgatttttctatccattaagaaattaccaatatggaaaataaatttccttaagggaaggtggaggcataggcagattgattctgctcaccctccatcttattcccccaagtgtagattggtcttgttaaatcgcccatgcacttgttgcagaaacagtcaaaatggcgggttagaggctgttagcatgcctcagccactcggaaatagcaaaacagtgcataaagattgacactgtgagctttaattcacgaaggaaagtgggaattcaccagaataacaaaggacactccagatccaagggagaagatagtgggcaagccaccccctgatggcgtttggctggtaaaacgatatgggtgcagtggaacattttctttcatggccagacatatctccaggcttttgatgcaccatatctcctgggataggagcttcagttgccattcttttcccacacagacaatttagtacagcagcactccctccacgtcacactcagacatacctccagtcatttggcacacacacgtccacagattagtagtttgagccattcatcccttcccatgcaaagaccttattacagcagcagtttctctgcttttggccagggtatatttgcaggcatttgacacacacattctcttggcttaggaatctgtgctgcccctcccttcaggtgcagagattgtggtacattggtgctctctcttcttgatgcccagacatatctctggaatttggagcactcactcttctaggttatgatttaggccacctcactcttcccatgcagagaacctgaggcagcagaagtttctagaattcatgcctaggcacatctcctggttctcacaggctgcccactgggacccttttcaaagctgatgcatgtgcatgccattgggaaacctgtgggtgggcctgctcagtctggtcccacacatcttggatctttcctaaggaggaaggtgataccactgtgcattccacagatcaacccatggtctgaggcaacagagagcttctcccattaaaaaaggattaggtatatacccacctattttgaccacaggtggctcatacccataagtgacacctactggcctagagtttgaaatgcaaaacacaatagaaaatgatattgattcttcctatccatgagcatggaatgttcttccatttgtttgtatcctctttaatttcattgagcagtggtttgtagttctccttgaagaggtccttcgcgtcccttgtaaggtggattcctagctattttattctctttgaagcaattgtgaatgggagttcactcatgatttggctctctgtttgtctgttattgatatataagaatgcttgtgatttttgtacattgattttgtatcctgagactttgctgaagttgcttatcagcttaaggagattttgggctgagtgaaaatggccataccacccaaggtaaatcatagattcaatgccatccccatcaagctaccaatgactttcttcacagaactggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatataaatcaatggaacagaacagagccctcagaaataaggccgcatatctacaactatctgatctttgacaaacctgagaagaacaagcaatggggaaaggattccctatttaaaaaatggtgctgggaaaactggctagctatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttcccaaaagaagatatttatgcagccaaaaaacgcatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggaccataaatcatgctgctataaagacacatgcacacgtatgtttactgcggcactattcataatagcgaagacttggaaccaacccaaatgtccaacaatgataaactggattaagaaaatgtggcacatatacaccatggaatactatgcagccataaaaaatgatgagttcatgtcctttgtagggacacggatgaaattggaaatcatcattctcagtaaaatatcacaaggacaaaaaaccaaacaccgcacagtctcactcatagatgggaattgaacaatgggaacacgtggacacaggagggtgaacatcacactctggggactgttgtggggtgcggggagaggggagggatagcattgggagatatacctaatgctaggtgacgagttagtgggtgcagcgcaccagcatgtcacatgtatacataggtaactaacctgcacattgtgcacatgtaccctaaaacttgaagtataataataataataataaaaagaaaatgagctgacacaagtcaacagacaagtcaacagcagtggggaatgagataggcttcctgagatctccatgattccagtccaataggaagcattgagcctgctcacatgcacagtgcattgctactaaaaataacattcaggaaagccatcatacaaaggctatatgtaaccaaagaacttatacagactctttagccctgaaagcacccagaaccaaagccagaaggaccctacaaatcatacattatagacacctcctgaaggagaaaaattccatccaaattaaaacaaattcaaaaaataaggagagatagcttatctagatgataaagaaccagagaaacaactatgaaagtatgaaaaacagagtgccacaacacttcgaaagatcacactgattcttttttttttttttttttttcttttgagatgaagtctcactctgttgcccaagctggaatgcagtggtacaatctcggctcactgcaacctccacctcctgggttcaagcaattcgattctcctgcctcagcctcccaagtagctggcactacaggcatgcaccaccatgtccagctaatttttgtatttttagtagagacggggtttcactatgttggccaggctggtcttgaactcctgacgtcctgatccacccgcctcagtctcccaaagtgctaggattacaggcatgagccactgcacccggtccacactgattctttaccaatgaatctaaactaaatgaaatctttgaaataccccatgaaaaattaaaaatattgattttaaagaagctcaatgaaatccaagacaaagctgaaaaaaacacaaagaaatcagaagaacaattcagaatattaaaaaagggtagatatcattaaaaaacaaacagaatttctagaaataaaaaattcattaaaataattacaaaatacagttgaaagttttaacagtaggctataccaactggaagaaataacttcagagctggaagacagatcttttcaattaatccagtaagataaaaattaacaaagagtttttttaaaaacttaacaaagcctttgagaaacataggattatgtagtgtccaaacctacaaactgtaagtattccagaggaagatgaagaaaaagtaaaatgtaaggaaaatgaagaaataattcagcaaaactcccatgggattgtcttttttgtgcaaatggtagctatttttattatttccttttttttttaaattttactttaagttctgggatacgagtgcagaatgtgtaggtggttacacagatatatgtgtgccatggtgatttgctgcacttatcaacctgttatctaggttttaagccccacatgcattagctatttgtcctaatgctctccctcacctcagccgccaccccccgactggccccggtgtgtttttttccccttcgtgtgtccatgtgttctcattgttcaattcccacttatgagtgagaatatccagtgtttggttttttgttcctttgttagtttgctgaggatgatggcttccagcatcatccatgttcctccaaatgacatgatctcattctttttatggctgcatagtattccatggtgtgtatgtaccatattttctttatccagtctactattgatgggtatttgggttggttccatgtctttgatattgtaaatagtgtaaatcaaaaccacaatgagataccatctcacaccagtcagagtgatgattattaacaagtcaagaaacaatagatgctggtgaggctgtggagaaataggaaagcttttacactcttggtgggtatgtaaattagttcaaccattgtggaagatagtatggtgattattcaaggatatagaaccagaaatgccatttgaccaagtaatcccattactgggtatatacccaaaggaatataaatcattccactataaagatacatgcacaagcatgtttattgcagcacttggattgtcttgggagaaatttggacatctagatacaaaaggctcagagaattcctagtagataaattggaaaagcctcactaatgcatatagtcatcagaattttcaaagtcaaagtggaaaaaaaaatcctaaaatcagcaagagagaagcatctaatcacctataaagaaaatcgcatcaaactaacaaaagacttttcagcagaaaatctacaagccaaaagagattggaagactatttttagtctcttccaaaaaaaaataccagctaacaattttatatcctgccaaatgaagattcacaaatgaagatgaaatagtctttccaagacaaacgaaaggaattcattactaccagatcaccttacaagaaactttcagtacaactttcttcacaacaaagtttcaatgcaacaaggtttaactatctatcctaaatatatgtgcatccaacaccagaacactctgattcataaaacaaatactactggtcctatgaatagagatagacagttatacaataatagtggaggacttcaacaccctattgacaccactagactgatcactgaagcagaaaatcagcaaagaaacttaacttaaactggactatagaccaagtagacataataggtatttacattacatttcatcctaaaccacagaaaatacattattttatctttggatagagcattctcctaaaccgaccatatgcttagccatccagcaagtctccataattttttaacaataaatcatatcaagtatcttcttggatcacagtggaataaaattagaaattaataccaagagtaattctcaaaactacacaagtaaatggactaaacaacttgcttctgaatgacatttgtgtaagcaacaaaattaaggcagaaatcaggaaagtttttgaagcaattgaaaatacagacacaatatttcaaaagctctgggatacaacaaagaaaagtactaaaggcaaagtttatagtgttaaatgtctacatcaaaaagaatgatctcaaagtaacatccaaattttgcacctcaagcaactagaaaaaggacaaaccagacccaaatctagcagaagaaaaaaaataacaaagattatagtaaaactaaatgagatcaagaccaaataaataacaaaaaggaccaattaacagctagttctttgaaaggataaacaaaattgacagactgctagttaaattaaccaaggaaagaaagagattcaaagaagtacaatgagaagtggtaaaagtgacattaaaactgatactacagaaatacaaaagattataagagactactatgaacacctttatgtgcataatctagaaagcttagagaaaatgcatttctagaaaaacagacaacttcccaagattgaagtaggataaaacagaaatcctaaatagacccataatgactaacaaagttgaatcatcaacaaacatctaccaacaacaaaaagtccaagaacagaaagattcaaagccaaatttcatgagatatacaaagaagagccaatactcattttactgacactatttcaagccatcaaggaggaaagactcctccttctctcttttaacaaaagtggtatcatcttgataacaaaatcgagcgaggcgacaatgtaaaagaaagctactggccaatatccttgatgtgcctaatgcaaaaatcttcaacaaaatactagcaaaccaaatccaacagcacatcaaatatacaatacaccatgatccagtgggtttatccaaatgatgtaaggatggttcaacatacggtaatcaataaatacggtttaccacataaagagaactaaaatagaaaaaacatatgattatctcaagagatgcagaaaattcatctgataaaatcaacacccctttatgatgaaaaccctcaacaaattaaacattgagaaacatacctcaatataataagagccatgtatgacaagtcaacaaccaaaattatgctgaataagggaaagttgaaaacaatctccataagaactggaacaagacaggatgtcaactcttattcttattcaacatagtagtggaagtcacttgtaatgtcatttttaccatttatcattattcttctgggaatttctcttatctcttggttaatttaactagcagtcaattctgtttatccactcaaataactaattgcttgtttagttgatcctttgtgttgtttatttggtcttgatcttatatagttctgctatgatctttgcctgatctttcttcaggcaaaataaagaaaaggcattgcaattgggaccaaaaaaaaaaaaaaatgtcaaattatctctgttaaatgatggcataattgtgtatcagaaaaccctaatgactcccccagaagacctctccacttgataaatgacttcagtaaaatttgaagacacaaaatctgtgtacaaaaatcagtagcatttctatacaccaataacattcaagctgagaaccaaatcaagaatcaatctcatttaaaatagctgcaaaaaataaaataaaatacctagagatacaattaagcaaaatagttaaatatctgtacaagaagaatgacaaacactgatgaaagaaattatacatgacaaaaacaaatggaaaaccatcctatgctcatggattggaagaatcaacatcattaaagtaaacatactgcacaaatcaatctacagattcaatgcaatgcctatcaatttagcaatgttatttcttacataattataaaaaaaaaatcttaatgtttagatggaagcaaaatagatcccaaatagccaaagcaatcctaagcaaaaaggacgaatctagaggaatcacattgtgtgatttcaaattatataatactataagtctatagtaattaagatagcatgctactagtacaaaaatggagacatagatcaatggaacagaaaagataactcagaattaaagcacacacttacaatcagtcgatcttcaaaatgttaacaaaagtaaatagggaggaaagatgctctattcaataaatgatgctgggaaaattggctagccacgtgcagaataatgaaactggaaccatatctctcactgtgtacaaaaatcaagtcaaagtggattaaagacttaaacataagaccagaaactataaaatcctacaagaaaacctagaaaaatctcttctggacatttgccttagcaaataatttataatgatgaccctgaaagtaaatgcaacaaaaacaaaatagacaaatgggtcttaattaaactaaacagcttttgcacaacaaaataaataattaacagattaaacagataacctaaacaatgggagaaaatattttcaaatcatgcttctgacagaagactaatatccagaatctacaagaaactcgaacaactcaacaagaaaaaaaataattccactgaagagtgggcaaaaacacggacatttcttaaaagaagaaatacatacagccaacaaacacataaaaaattgctaaacatcagtaatcatcagagaaatgcaagttaaaatcacaatgagatataatctcacccagtcagaatggttaatattaaaagtcaaaaaacaagagatgttggtgtggatgtcaagaaacggcaattgtttatacactgttggtgagaatgttaatcagttcatcttctattaaaaacagtatgtagatttctcaaagaagtaaaagtagaactaccgttcaacccagcaatctcatccctgagtatctacacaaaggtaaagaaatcactgtaggaaaaaggcatctgcatttgtatgttcaacacaatactactcataataggaaagtaatggaatcaacctaagtgtccaacagcagttgactgaataaggaaaatgtggtgtatacatcatgacaaactgtgcagccattaaaaagaataaaattatgtcctttacagcaacttggatggaactagaggtcattatcctaagtgaactcagaaaataaaatattccatgttctcattcataagtggaaactaaacaagaggtacatatagatgcaaagatggaaataacacacctcagagactcaaaaatgagcgagggtagaaaaagtttgagggttgaaaattacctattggttacaaagctcactatttggctaatggatagagtagaagcccagtccctaaccaatatacaatataattatgtaacaaatatgcatatatacccccgaatctaaaataaaattaaaattaaaaaaagaaattaatattagctgtagagagtagtatatcttcactgaaaagttatatgttaattttgtatggtgcaccagaatatataaaagtatatttacagtacataaaaattgtaacaaaatatatatttccttttaaaatggtttctggaataaacgactcaacagaaaagcaagactaaaggtaaacaagaaagctatatacatataggtttcttatatatgtgtgttagtatacatatatacatatatataattttagattcaggtggcacatatacatatttgttacattattatattgcatagtggtggggattgggcttctactctacccattagccaaatagtacatatatatatagatatagatatagatatagatatataaatagatacacacatgcacacctatgcacacatacatacatatatttaaaaacacagctaatgtataccttacatatatattacatacacatatattttaaaagcatgttcccattagtccgaaacacagaaatggattttatgaatttgtatgccagaataagacatcacattgagttgtagaatattccaacactgtgggttcatgagccattctgaaaaataaattacaccaataatggattccaatactttaaccatttcttgcgaaattttctatatattaatattactaatttgtaaaaatatttacattatagtcacagacactaaaaaccttaaaatcattgaagaaaatgtccattttcttagtaaatgaatgaatatttaaattatacagtaatgagcgaaatttagtaatgaactgaagtttaattcaaaattacaaattagcagcttagatcaggcatgattcctcatgccagtaatcccagcaatttgggagaccaaggtggaaggatcacttgaactcagaagtctgagacgagtctgtgcaacacagtaagacctcatctctacaattgtttatgtttatataaatataattatatatataattatatatatatataattggaaactcatttctctgattaaacaaaggaatgtaattaataaaacactgcaacctcattattcataaagaaatagtctacaatttgtatttcactctaagcaactcatttaggagcttgaaaattttatttttacagttttttaaagcacaaaatgagcacattcaagctaaaactgataaaatgggaataataccatccatgtgagtggctgagcctagtaataatttgcagtaaatattatcacaaaaagttggaactggaattcttgggaaactgttttctgctgaataatttcaagttggaattcagttctggtaaaaaaaaattactgctgatatgcactaacttgattgtcacaggttagcatgtaaatgaagaaagatttaagcaggtacctgtctaaattaatgtaggcagctgttacaagtacatgcattcaaacctcagggcatagctctgcctctctaaaaaggacttgcccaagatcagaatatagaataagagctttacattttatctttatttaaattctccctcccctttttgtggaattgtgagtgagcagcaatactacatgccttttataaccctttctaaaaatatattgaccacagttttactaacagttagaaaattggagtatgatctcaaatatacttaatgaagacacacattccacagaaaaaaattagtttaaatttagtttcctaagaaaataattattattatagagaaactattttgaaaaaggagataagaatttaaaatatttgtaaaataataaagttgattctccagtcatacctcaaaatcagtttcatctttagcacatttctacccatcaggggtgtgtgtgtgtgtgtgtgtgtgtgtgtgtgtgtgtgtgtgtgtatttgaattgacagtgaatagctataaaataaagtggtatgaaacaggaccgaaaatgctagagaaagagaatgatgagagggcacaggtcaaataataaaatgagagatatggaattcagaacttggttttcaatgaagatcatcgagattcacaacaaagtataaatgcaatccaagtaatctaaggaatctagcaaaatgacataagagctgaaagacaaaatattcatttataaaaggaacaaactgatctgatgaagctaaaaagctgactacaaaaattttgaaaaacaatcaaaagcactacacagcagaataggccaagctgaagaaaatctcagagctctaagactggttcttcaggtcaactcattcggattaaaaagaagaaaaaaaaaacagagtaaacaaaataaacaaaatctctgagaaatatgggattatgtaatgagaccaaacctgaaattaatttgcatctctgaaagaaagagagagattgcaagaaacttggaaaatatttttgtgggtattaacattaaccatggaaatgtctccaatattgctagagaggttgacatgaaaactcaggaaagacatttgagaactatactcaaacacttgactagatgagcctaacagatatctatagatttctccaacaaaaaacagcagaatatacattcttcttacctgcacatggtacactaaaatcaaccagatgattttccatgaagcaattctcaacaaattaaaaaaaacacatgcacacaaaatcatatcaaccacattgagaccacagcacaataaaaatagaaatcaatacacgggagatctctcaaaactataccattacatagaaatgaaacaatctgttcttgaatcacttttgggtaaacaatgaaattaaagcagaaaacaagaaattatttgaaactaatgaaacaaagatacaacataccagactctgggacacagctaaagcagtgttaagaggaaagtttctagcactaactgcccacatcaaaaagacagatttcacactaacaacctaacaccacactgacaggaactagaataacaagagcaaaccaatcccatagatagaagaagacaagaaataaccaaaatcagacctgaactgaacaaaactgagatgcatcaaaccatactgaagaccaacaaaaatatgttggttctttgaaacaataagattaatagactggtagctagactagaaaacatgacagaagatccaactaaatacaatgagacgtgacaaaggggatattaccactgatttcaaagaaataaaacaaaccctcagagaatctggtgcagatttctagtcacataaactagaaaaccttgaaggaataaataagttcctggaatcacacaacctcctaagattgaaccagaaagaaattgcaaccctgaatacagcattaatgagttacaaaattgaattagcagtaacaaaccaaccaaccagaataagccctataccagatatatttacagctgaattctacaaagtggcttaacaaaatctggtaccaatcctactgaaactattccaaaaaactgaggagggacttctccctaacttactctatgaggccagcattattctgataccaaaacctggcagaaacatgaaggtaaaagagaacttcaggctaattactgtggtgaatgtagatgcaaaaatcctcaacaaaatactagcaaactgaatccagcagcatatcaaaaagttaatcaaccaaaattatgaaggctttattcctgggatgcaaggttagttccacatttgcaacacaataaaatgattcagcgatccatcgtataaacagaactataaaccaaaccacgtgattatctcaatagacacagaaaagacttttgataaaattcagtgtccctttatggtacacatcctgaacaaagaagacatcattttgaatatacctcaaaatataatagccttctattgactgacccacagagaacatcatactgaatcggcacatgctggaagaattcttcttgagaactggaacaagacaaggatgcccagtttcaccaatcctgttcaacatgatattggaagtcctaaacagaggcataatgcaagaggaagaaataaaatgcatccaaatagagaggtattcaaactatctctgtagacaatgggattctatgcctagaaaaccccatagtccctgcccaaacactcctagaattgataacgtcagcaaagtttcaggatacaaaattaatgcacaaaaattgtagcatttctatacatcaatagtgtccaaggtgagagccaatcaagagcacaattgcattcataatagctgcaaataaataaaatacctagaaaaacagctaactagggaggtgaaaatatttacaattagaattataaaacactgctgaaagaaatcagaaatgaaacaaacaaatggaaatacataccatgctcatggataacaagaatcattatagtaaaaagggcatactgtccaaagctactacaaattcaatgctattccattcaaactaccaatgtcatttttcacataattacaaaaaactattcaaaatttacatgaaaccaaaaagagcctgaatagccaaagcaatcctaaacaaaaacaacaaagttgaaagcatcacactacctgactttaaattatacgacaaggcaataataaccagaacagcatgatactggtacaaaaagaaacatataaatcaatggaacaggttaaagaacacagaaataaagctacacatttataaccatctaatctgggacaaagtcaactaaaacaaccaatgggaaacaactccctattcaataaatgaagctgcagcaactggctagccctatgcagaagactgacactggatcctttcctttcaccacatataaaaatggatttaagacttaaatgaaaaacttaaaactatgaaaattcttgaagaaaatctagaaaatactagacattgtccctggcaaggattttatgactacgactacaaaagcaattgcaataaaaacaaaaattgacaagtgggacctaattataccaaatggcttctgcacagcaaaagaaactatcaacagtgtaaatagagaacctacaaaatgggataaaatatttgtaaactagacttctaacaatggtctaatatccagaacctataaggaattcaaacaattgaacaaccataaaacaaacaaccccattagaaaataagcaaaagaaatgaacagacatttctcaaaagaagacatatatgcagtaaacaacctataaaaacattctcatcatcaataataagagaaatgcatatcaaaaccacaatgagatagtatcttacaacgctcagaatgactattattaaaaagtcaaaaacaaagatcctggcaaggttgcagagaaaagggaatgcttaaacaccgctggtaggagtgcaaatttgttcggccactgtggaaatcagtttggagatttgtcaaagaacttaaaatagaacaatcattcaacccagcaatcttattcctgggtatatatccaaaggaatataaatcattctaccatgaagacacatgcatgcatatgttcactgcagcactacttatagtaacgaagacatggaatcaacctaaatgattatcaatagtggactggataaagaaaatgtcatacatatataccatggaatactacacagccttaaataagaatgaaatcatgtacttttcagcaacgtggatggaactggaggctattatcttcaacaaattaatgcagaaacagaaaaccaaatgccatatattctcacctatacatgggagctaaacattgagtacacatggatacagacaaaggaacaatagacacagggcctacctgagggtagagggtgggagttgaggatcaaaaagctacctattgagtactatgctcattacccaagtgatgaaataatctgtacaccaagcccccatggcatgcaatttaccttgtagaaaacatgcacatgtaccccaaacttaaaataaaagttggaaagaacaaatcataagaaagtaatcaaagtagaacccagatataaatccatgcattcacagccaactattttttgaaaaaggcaccaagaacaggaaatggggaaatgagattttcttcaataaatgatgctgagaaaactggataaccatatgtaaaagaatgaaaatggactcctatttctcaccatatacaaaaatcaaataaaaataaagacttaaatttaaacctgaaactatgaaactattagaagaaaatattgaaaaaatacttaacgacactggtctatgtaaagagttttctttgtgtgtgtaatatctcaaaagcacaggcaaccaaagcaaaatatagacatatgaaattacattaggctaaaaaccttctgcacagaaaagaaaacaatctagaaagtaaagagacagccagagaatggaagaaaatatttgcaaactatccacctggcaagagattaacaaccagaatatataaggagctcaagcaactcaatggcaaaaatagatgaaattaaaaatgggtagaagatctgaaaagacatttttctaaagagacatacaaatggcccacagttgtatgttgaacaatgaaaaattgttcaacatcactagtcttcagtgaaatacaactcaaaagtgcaatgagctattatcttaccatagcttaaattgattttatcaagaagacaaggaataacagatgctggcaaagacgtgaagaaaggagaactttgtacaccgttggtaggaatgcaaattagtgcaaccactatgaaaaaaagtatgacagtttctcaaaaaaattaaaaataaaactactatatgatccagcatttccactattaggtatacattcacaaaaaggcagtatattgaagagatatcttcactcccatgtttattgcagcactatttgctatacccaaattatggaatcaaccaaagtgcccatcaatgaataaagaaaatgtgagatagatatatatatatatatatacacacacacacacacacacacacacacacatatatatatagttgaatattgttaagtcatacaagagaatgaaatcctgtcatttgtagcaacatgatggaacaggaggtcattataagtgaaattagccaggcacagaaagacaaattgcatgttctcactcatatgtgggaactgaacaagtgactatcatgaagataggaatttgattattgggtaccagtggccaggaaaggtagatgggaagggagggtgaagagagtttgaataataggcacaaatatacagtttgagagaagaaataatatctagtgtttgatagatcaatagggtgattatagtttgcaatgattgatagtatatttcaaaatactaagaataatttgaatgtttctagcataaacaataaatatttaatggatatctcaattacactgatttgatatttacaaattatatacatatatgacattatcacatgtaacctgaaaatatgtacatctattatgaatcaatgcaaaaattggaaaaaaaaattaaaaataaaaataaatataccaacaatgctgtgaataaaggtaatcaaagcagcacagtagaatacagagagcatggaatgagaagcagacaaacttaaattcaaattcatattaggagacttctagctaaatgatcgggggcatatcacattaataaaaattattaacctccagagagccagagccagagacagagcaagtcagacacagagaatgaaaaaacatccaaactaccaatatccttatgaaagacgggacatcactatagaacttaaaaataacaaaaatataataaggaaatactgtaacaactctacatttgcaaattcaccaacaaatataaaatggaccagtttccttgaaagacacaagactcactcaagaaaataatggataacctaagacatgtcatatatttagtcaagcaattagatttagacttaaaaattcttccaacaaagaaaaattttgtctggatggactcactggggaattccactaaatgctgaagaaggaattttaacaattctgaacaatcccttccaaaaaatagaagaggaagtaacaactctcacctgattttacaagggagcattgtcctgatactaaagtcagacaaaaacatgatcaagtaaaacaatgaactaatctctctcatgagcatagatgcagaatttcttaacaaattattaacaaattgaatatggcaatatatacaaaacatactacatcacagtcaggtggagcagattccagtaatgagagcctgtttcaacatcagaaattgagtctacataattcttaatattatcagaataaaaagaaaaatcaatagattcagaagaaaagcatttgataaaattcaagatttgtttatgatatacactttcagtaaactataagtacttccttaacctgatagagtttgtctacgaaaacgtacagctaacattataatggcgaaagactgacaaagcaagtatatctcttcctcatcactactatagaacattgttttggaacctagacagtaaaataagacaaagaaaattaataaaatcctccagattggaaagaaagctctctctattaaaaagagaacatgattatctatgtagaaaatatctgaaatctcaaaaatgaaaagaaaataaactttcaagaatagcaaaagaatttagtaagtcacaggatacaaaaatcaactgcatctctgaatgttaacaatgaacatctttaagtcaaaaactgtaaccataccatgtacaatatcataaaacaattagatatttaggttaaattctaacaaagtatatgcatgatctatattcagaaaaatacaaaacacaaaagaaatgaaagaaggcctaagtgatgggtatacatattctgtgttcatgtatttgatgacttattaatgagataaattattcccaaattgattctatacatttccaattgaattcttagcaggatatttttagataccaaaaaactgattataagtttacatagaaaaggaaaataattataatatccaaaacattttgaaaaagaatttatttcaagatctcccactacctgatattcaaacttttttaaagttatagtaatcaggacagtattttattggcaaatgggtagatacacatatgaaaggaataaaataaatagaatataaatagaaccacacaaatgtttattttctgacaaagttgctttaaagacaataataaaaagacttaattttaaataaatagtgccagaaaaattagacctccaaacgtaaaaacaaaaatggaccttcacctgtacttcacattttttatcaaaatcaacagtaaaggatatagatataatatagaatgtaaaatgttaaaactttacaaaaaaaaacaaagaaaatttggaacataagtttaagcagccattttatagaaagaatatcaagagaaaaaacattattaattggactttaacacacttaaaaaaatgctctgccaaaaaacatatttaaaaagtgaaaagactagtcaaagattagaaaaaatatgtatttgtcaatcccctatctgacaaactgtatgcattcaacacagagaaagagcaattatgacacgataataaggaaaatatgtgggcaaagttcagtacaggcactttaccaaagaagaaatatggactgcaactaagcaaatgagaagatgctcaacaacagtcattaggggcatgcaaattgaaaccacattataatatttttttaaaggctaagattacaaagaaaacaaaaccttgttacactaaataccagtgaggaagtagagcaattgacacactcatgcattgctggtgaaaatgcaagataagacaacaactttggaaaatagtctgccagtttttaaaaagtgatcatttaactaccaaatgaccttgcatcaccacccctaggtatttacccaaaacagattaaaacttatgatcactcagaaatctatgcaaatggctatattgcccttattcataatggtgaaaaatggtaagcaatcgaaatgcctttcagctaataaaaagaaaaatgagctctggtaatccatacaacagagtactattgagtggtaaaaaaagaacgaaccaactattgatacctacaatccatgtggatgagtatcaaatggatatcctaactgaaaaaagtcagattcaaagggtcatgcatgatttaatttacatgacattcagtaaaaagcaaaactataagaaagagaaaattttgctacaaagcagcagcatggaagtttctttggggtaatgaaactatttcagtatctttattgtgatggtggttacaagactacatgtttgtcaaatataatatttcataccctaaagtgtgaattttactatataaaattcagttaaaatcattaaactatacatttcaacttattatatgaaaactaaatcataatacaactgacttttaaaaaacatctggtatattaaccactttattatactatccctttatagaaattctcatgttaaatctatatattttatgcatagaaaaatctacaagaaaagatagtctcaaaagtatatttgtccatgaggattttgcttttgaccaatttggttaattctactattttattatttgagtgtcttgaaaaatattctgtgtattttctgtgtcagtcagaatgattgccattctaactggtgtgagatgatatctcatagtggttttgatttgcatttctctgatggccagtgatgatgagcactttttcatgtgttttacactgttggtgggactgtaaactagttcaaccattgtggaagtcagtgtggcgattcctcagggatctagaactagaaataccatttgacccagccatctcattactgggtatatacccaaaggactataaatcatgctactataaagacacacgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaaaaaagaaatatactttctgaatgtcaagatctcgactttctttccttaggtcaaactgcattttagagttatccctcttgagcacttagaagctgcaataatcctggcaattggcaaactggagactgaatctaactctgtagcatgtgaccatagacaacagtatcatcacattatttctctaaaaaacagccaccttgctcttgataaatgctgtaattcccattttagtagacaatccttcctttcagaatcaggtttgccatttgattttatcaatcacaagtttcaaatgatcaataatccattagaattattttcaaaaaaatagcttttggaagatgatttcaacatatttctttctctctcacccaccccatcccccaacaaacgcagccctcagtatttataaatgtgccccatgctgctttcttggtcatgctatgaccatcaccagcattacacatgttgttgtacttatcttctttctaagaatacttcaatcatcatttagtacaaaataaaattcatgtttctaacaaaaactcttcttcatctcggcaaaaggagaactctttcctctgcagttgtgtgtagtttttgtatgagtttagtaagatatattagatggtacttcatagtagttacgtaggtctgaatataccttcttctactaggttttaaggttcttaaagacagtatatcagcatttttgagaaagaactttaggcgaaaattcatgtcccatatttttgttaggaactatgattctagagaatagggtgtgagggaaaaggagagtgaggcaggaagcaagcagggtcaatatgacaatgcattactgagctggtcactgatggcatcaggtataacgaatcacttgattttgaaggactgtcttcaaaaaggtcaaataatctctttccaggggggacaaaatcataggccagcttctgtttctctctgaattaaggtttaccagagggagcactaccttcctgtacaaatggattgcacatccatgagtgctacaagggtcccaaagcattacatgcctcagtggcagcactgaattctcacagaagacatgaaagaagcacagaaaggacctgatgttagacctgccgggtgcttcttatgcgaaactggccagaggtcactcatattcgttgctccaggtgctggcgctgacccagtggctatctgccctggatataggtgacactgaaagaacctgaagtggcacataagaggtgtctgattgagcatgcatttgtggtaaagctgtaaccataaagctgaagttcatctttgaatcacccactatactacaaaatggtgtatacatcaattattaaaatacttgctaaataaataagatttctaagaatgtataatggaaaggtaagagtgaatgctcacaatataggtgagcaatcctgcttacagaaaaggtaatgagttagtaaattccaaatgtatgaaattgaaaagagtgttaactactagtgtaagtacaaaattatacaaatactttgctgaaaagtcagggccattttcttattctaattttagtgaaaacagctgtgtgacctctctgggcctcactttttttcatctgtgaagtcaaaagcataaatttgatgacatttaagattttagtcaaactttgaaactgatgtgtttgaagttctgaatctatggcaaataaataattaaatattaatttattaggtatgattgagtacaaattgtgagttaggcacctctccagttcctaagaatacagtaatgaaaaagcagatatgaatactgccctattcgagtttaaatcctaatgtggagagtcacaaagcaaaataaatatctatgcaatatgttagaagtggggaggccagagaactgcattgcatgtttactcgggtggccagggtaggagtcactgaaaagctgagctgaaagatccagccaaatggataatgggggaggagcactctaggccattgtctgagcagggggtgaacttcacatgttctggagaataacgaactctttgacttgagccacatgatagaagttagagactgttatgaggatgatgccaaagagttaagaaggacagatcatgtagcaccctaggacattttgagaaatttgggttttactcagaatgagtcattgaggattttgagcagataaatgtatagcttgatttaggtttataaaaggatcaggatcaaattggctgctatattgagaatagattataatggggcaagtgtgtaaacagagatatggaaataaatagtttccaaaagacacatctagcataatttctgtaaggtaacaatgtggctaaaatgtgttttaatttagtatttttatggtcgtcagggtggttaaaaggttttatttattttaaagtaggtaaaacatgaatttactttacaaacatgtaaaaaacaactaataaaagttctactcaaactatttcaaaaaattgaagtggagggaatacttcaaaactcattctatgaggccagaattaccataccaaaaccagacaaacatgcaataataataataactataatccaatatctcttataaacacagatgcaaaaatcctcaaaaaacactagcaaactgaattcaacaacacaataaaaagatatttcaccatgattaagtgaattcatcccagagacgcaagtatagttaaacatatgctaatcaataaacatgatacatcataacatatgatcatttcaatagatgctgaaaaggcattccataaaatccaactttccttctttaaaaaaaaatttcctttggttattatcttgattaaaaacacctaacaaactaagtataaaagaagtatacctcaaaatagtaagggccacatctaacaaacccacagctaacataatactgaatgggaaaacattgaaagcctttcctctaaggtctgtaacaaggcaaataggctaactttcaccactcttattcaacacagcattggaagttctagacagaggaatgaagcaataaaagtgaataaagaacattgtaaaggaagaagtcaaattgtccttttttgcagatgatatgatcttatatttagaacataaatattgaaaaaaacctaaggattccactagaaaccgttagaactgatccatgaattcagtaaagttgctacaaaatcaacatacaacaattaataacatttctatattccagcagtaaacaatctgaaaaaaatacaagaaagtaattcaatttacacagctaccaaaaacaaacaaacaaacaaaaacccgggaataaatttagccaaaaaagtgcaagatctttactggaaaactggaaaagattgataaaataaattaaaaaggagacaaaaacatggtaagatacctcatgttttgggattggaagaattaacacagttaaaatgttcataccagctaaagtgatctacagattcaatactatccctatcaacataccaatgacattcttcacaaaatcgaaaaaaaaaaaaagctaaaatttgtatggagccacaaaagaccacaaatagccaaagcaatccagaactaaaagaacaaagctatagtatctaaaaaacagcatgatgccgtcatagaaatatacacataagccaatgtaacagaatagagaacccagaaataaatccatgcattttcagccaactcatttcaaaaatggtgccaaggacatatgctgataaacaaatacttttcaatgaatggtgctgggtaaactagatagccacatgcagaacaatgaaaatagactcttacctcttactacatacaaaaatcaaataaaaatggattgcatacttaaacgtaaaacctaaactataaaataactagaagaaaacattggggaaacacttcaggactttggtctagacaaagattttttgggcaagtcctcaaaagcacaggaaagaaaagcagaaatagagaaatgggattacactgagctaaaaatacttctacacagcaaagaaagcaatcaacaaagtgaggagacagtccacagaatgggagaaaatatttgtaaactatccatctgacaaaagggttaataatcagaatacataaggaactcaaataagacaatggtaaaaaacaaataatcaaattttaaaatgggcaaaagatcttaatagatatttttaagagaagatacaccagtaggtatgtgaaaataatgttcaaaatcactagccatggggaacgtaaatataaaccacaatgaaatatcatctcaccccagttaaagtagctataattaaaaagacaacaaataaccaaagctgatgagaatgtagaaaaatgtgaccctcctacattcttggtgggaatgtaaattggtacagccactatggagaacagtatgaaggttctactgaaaactgaaaatagaattagcatatgatccagcaattccattccttggtgtatgtccaaaaaaaggaaatcagaatatccacaaaaaatctgcagtctcgtgttaattgtactactattcacaacagccaagacatgacattaatctacgtccatcagcaaatgaacagattaagaaaatgtagtatatatacaaagtggcgtattaatacattaaaaagaatgctactctgtcatttgcagcaacatggatagaactggaggtcattatgttaattgagctaagccaaatacagaaaaacaaatatcccatgttctcactaatatgcgggagctaaaaaacttggtcttctggagataatgactataacagtggttatcaggggctggcaagggtagggtagaggatggatgaagaaagattggttaatggatacaaaaatatatatagatagaaggcacaatttctagcatttaataacacagcaggagtatagctaacaataacttattgtacatttaaaaatggctagaagatttggaatgttctcaacacaaagaaatgataaatgtgtaagatgatagctaccccaattaccttaatttgatcattacacattgtatgcatgtatcaaaataccatatgtaccacataaatatgtattattatgtaccaatattaaaagaaaaaatataaacagaaatatatttatacattctcttttttatatactaatatttaaaactaaatcatactatatactagtatacaaaaactatatattaatatataaaactaatacatataaaaataaagccatgcatacatatttagtaactaaaaatgtactctttctctttccaagtattatgttgtgtattcctctcaatgccatgaaataagtaatttttcatttacagatgaggtcacatggtcaaggacatatagaaagtgaaaggaaggcttacatattagtgaagcataatcactgatggcagaaaaaaaatgaagaatggggtggtagattcctattactgctattaccaatgactacaaaattgatggtttaaaacaacacaaatgtatcttataattttggaagtcagaagtaaaaaataggtctcactggactaaaatcaaggtattgacagggctgtgttttatctgtaggcttgaggcagaatccatttatttgccttttctagcttcctgagtctggtcacattgcttggctcatggctcatggcccccttctatctttaaaaccagcaatggccacctgagtctttctcaatttgcatcattctgacttctatttctgcttctctcttcgacttcaaaagaccattgtgattatattggacccacctcaacaatccagggtaatgtccttatctcaagtcacttgagtggtaatcctaactcaatcttcaactttaattcccacttaccatgggctataacatattcaacaattgtgaggtataagacattaacacctttgagtggctaatgttctgcctactacaaatggtgagataaatttgaggtgatgggatgctagataagtcttttcctttcctcataacttttgtcagaatctatgtgaatatatatagcagaatatgtaccatcactatttcaaggctatcccatttaatttttgttatgaggtcattgactctttacagaaaacatctaacatgtcagcgctttgtccttattattgtatttatctgtgtggtcatgaaagaagtggtctatgtgggagacttttccaaattatgaatctagaatacccataaatatttagtctcacttattcctacagtgtgtatgggtaagtgtattatttttcataagatgatggctggggaaattgggaatacagaacatgaagacagttaacatacgtgccagcctagttgttacccctcattatattacagactggtaaatgtatctacctaaatggaatgatgatgctactcaagactgaagaaggtagccttagaaaattttctaatgtagatcgttgaatgttgaagaccttgccatgttaagtgatgtagagaaaggtcctagaatactggctttctcctgaagagacaatagatttccactgatgacgtagagtgacacatcctgagtaaggctataaggattgtggagactgactttataccagggtgaagtcgggacatgttctttcttcaaaagcttttctttaaggcctgcattctagaaaggagagacagtcccaagggtactttcctaatgtcatggtacactagctcctgtgttaagttggcagcctggggtgagggaagaagtcttcgtcacaaagaatacattgcccagtaggaaaccactatggaaatttatggacttaagttattcaggaacagtcatattgcatactgagtttcaaatgaccttgtgtagaaatattcatcaatgtcttacaatattcaccataagtctggtaaaagttacaaactggtctttatctaaccgtttgaaaaaagaagggataggtgtccacaacacagtgcggagtgtttaaaagagagccatacaagcactaagaaagccagaagtgagtaaccagcagaaaagtagataaaggttctgatctggatccagatgataaatggaatggcaagtgaaaatcgggatatattttccagaagataaatgttcctggatatcttggaacatcaagtaaattattaagttcttatatataataaagcaagattgtagattcatctttttattcaggcatttgaggaaagtgtgacttcaaggactattgaaatctgagacatatgttctgggtacattaaggagaaggtatagtagtattgaagaatataaaaatatatttaggtctcgtaagtcagcacttctccttacattaactatatgactccttcattgtggattattattccatccaaaatttcctatttagaaggccacatttggttcatgcaaatacgaaaagatgccataatcggagaaaaaagtttggagatcatgaagatgcaaacaggagtatttcttaatactttattaagcttatacgaatacactaaagtacagttttaatttggcttctaagtatactttactctatacaaattaccaccacttgaaagaaaaaaagagagccagagatgaatatatagtttccaacataatatagaggcatagtagcatccttaacatgacatacactgtgctcctaaatactgctcctaaatattaaggataacatgctaaaatttgtctttatccccatgttttgggttataaaatattagatttagaaaaaagaaaaaaaaagaaagtaaaaagaaaccactctaacacaaggaattttattttcataaaacatccatatccatatactttgtaggcagttttcaaaatggctttcagtgatcctcttctcttaatattcatatcctgtcctttcagcttgatagttggcttgagattaatcacacttgagcttaatcacttccaagtctagatgacaaaagcctttgacttttctcttgcacattcttttttgccttcttatttattagccctgtcaaagctgcttctatgttgtgagatgctttatggataacatccatgtggtaaaatagtgaagtaggcctcttgccaaccaccagttaggaataaccatggaggaactgagtcccaccaacagctacttgagtgactataaaagtggacccatcactggttgaaccttgggataactatagcccaattgacaccttgattttagccttgtgagatattcagaaacagaggatgcaactaagcattgttttaatttctgacccatggaaactgagataataaatgtttgctgctttatccagtaagattttgaataatctgttaaacaaataaatagtacacatacatatacaaacttgcaagataaaacataactttagaggaaaaaaagaaatcaagcaagaactagatacagttaacataaacaaaactcatcatatttcattacagcatgtggaaattgtgaagtatctttttcttatatatgttaattactcagtaaaaaattagagtatcgctgaaatctgtataccaaagttgaaaaagacaaagaaaacttatagaatgtatgggaggtggtgaaaagataattaaaagattcaaaatcaaaatttatataacagaatttgtattttaagaaaaatgtaaagtgttacaaaaagtatgtctccttctctggcagtaattatcctatttgctataatataataaataggttttgagtaactgttttgtggccgatttaagcagcaatccacgtaaacagacacctggatttccttcagtaagggagcaggaaatgacaattacattcttcagcaaaaacattttatctttgtttacagacattttgtgtgtgtgtgtgtgtgaatgtttctcacaaattgcaaaggccccccaccagtcttaacaaagaatttatttgaccattaactatatttcatgcgtaacatatattttatgacatgaattatattttgaatttagatttttacattttgttaattactacttcacaagaaggggaaaaataaaaaatcttcaaaaagcaattatagctcaatgatttaaatcaattcaccgggttatggttgtggcagataataaaaaattaaattcttcttccaaagctaagttgattactctgagtacctacctgtgttcttccaaaattttataaattacgtgtgattggagctcagatgaaatttagattgctgattgactttaactataggaaaaactattcaaagaaaagattaaatgagaaccaaatccttttatatacacacagaaaaaaaaacatgaaagtgaaagtgatctaatcagaagtattacaaaaaatagacaagaagaaccaacagttatacgatctctctgataatggtaaattctctctttaagtaggcatgttgctattgatgtatgctgaatgagtgtgttttagttttccaacatagcaaatctgacagtgaacttgaaatcagttagactggtaaggggtttctggctggattccacataatgctgttggctcatgggatttccttggtctagccaggtttagaaacagtttttaatcagttaatactggatttattatgttaaagaatgggggagggtaaaactcactgattcagaaactggataatatataagtgtataatataaaattaatctgcagcgaaggccagagtgctttcaaatataagccagtacatttctttaacagtttccaaatgtctgggaattttaatcactaattatagcattaagtgagccaagaattttagaaaagaatatacttttattagatattttcttgaagatatggcagtctaacaaggaacaattttagataataggaaaacttattggaatagtagtcaaaatctccttcctgaactgtgagataaatacttaaaaatttactaaatccttcattcataaataattcttattttccacctattaatttgttaggtgattgaatgttatcttgcactcttatgtacaatagggtttctcaagcacagcactattcgcattttgggccagatgacaccttgttgtgggggtgtcctatgaattttaggatgtttaacagcatcctggcctttctccacctgctggatgatttgcgccctcccagttgtgacagccaaaaatgtttctaagcactgtcaaatgtccttttgggggcaaaataattgtctgttaagatatactgctcaaaaagaaagaggggaggagagcaggtagtggcgatggttaatgggtacaaacatacagttagatgaatggataagatctagtattcatagcaagaaagagtgactacagtctgcaataatttgttcacattttaaaataaccaaaagagtataagtggattgtttgtaacagaaagaaaggataagtgcttgaggtggtgattaccccatttaccctgatgtgattatcatgcattttatgtctgtatcaaaatatcttatgtaccccataaatatattcacctattatgtatccacaaaaattaaaaattaatgaaaggtttctatgactcatgtgcaaatataattataatcttagtggtcacaaccagtatatatatttttatccttcttgtgtcagggttccccaggaccactctaaagtttgatgatatacatattcacaactatggtttattacagcgaaaggctacacagcaaaatcagcaaagggaaaaggcttatggggcaaagtccagcggacaccacgtacaagtttccaagaaacctctcccattcgagtcgcacagatgagagtacagatggtccccaacttacaattttttgactttacattgggtttatcagagtattataggcatttgtgacttacaatattttcaacttacaatggttttataaggtgtaacaccactgtaggtcaagaaacatctgtgattcatagcaatgagttgtaacaccagttgtggaatgtcctctagataagttcattagagacttaatgctaactgcttagcacataccacatttccagactttcagaaataaagcaattgtttagaaaaaccatcattgtttttacaaactgtttaggtactacacaccatgcttatcagttagggaatgacgagatccctttcagaaatccaagttcccagacaccagccactggtcaactttgcaaaaagatcattctaatcacagcagtctcaggtctgttatgttaaccctttctctatgctttcctacaaaatgttttgtgacatgtcagctgcattttaggcacccaaagacttatacaataaataggtgaactaattaatcaaccagtgatgttttcagttagaattccttaaatgtctctattgacacgtttgttcctaaggactcttacacctacaaagaggaaaatgttccacataataaagcataactacagttttataatagaggaaaattttagttaatcaaattgtaccagcattaacctgcatttccagaaaagtcttcaaacaactcaagatccaatgggaggaactcattttcagtgaaaagaaaatgatgtatggtaatattctggtcgatgtaactttcaaatgcaaccactaagagaaagaggaatttaaatttcttgaatctaagactccatgaataaccattttctgtcaaggagccaatattatttttaaaaataaaatcactcaatggttacatttttttttttttttttgagacggagtctcgctctgtagcccaagctggagtgcagtggcgtgatctccgctcactgcaagctccgcctccagggttcacgccattctcctgcctcagcctccagagtagctgggactacaggcgcccgccaccacgcccggctaattttttgtatttttagtagacacggggttttactgtgttagccaggttggtctcgatctcctgacctcgtgatccacccgcccccgcctcccaaagtgctggaattacaaggcgtgagccaccgcgcccgaccactcaatggttacattcttatttgagatatggagttgtctagagcccttcactcaagacgatctgctttagattaataggatgctttgagaaaataaacttcatgttacttttgagaaaatatgatgcacattaattttatgataattaatgttgaaacacctcccataaccacacatccctcttttatacacgggataaaattgttagtttagattttattacttaattattgtctggtcatcaccccttatcccctcctgaatatttaatgagaccaaggtccgtgctcttttttaattcacatttgtctctccaggaccttgcataggatgtagtaaagagtatttaacaagaatctgttaaaatgatttttttgaaaaagctcagagagataactgtccataccccatgtgtccccacggtatattcgatctttattttgaaggcaaacactatattttaaaaatcaaaatctaataaagataaagcaccatccctttacaggattgatttctttgattgtaaagtgtgcgaaaaaagggtttccggtgcactctgacaccattcataaaatcctaaccaggacctggtaaggccttagtttgtcaacactgtaccagaaatctctaatataaacaggctcatattataatcttctgcatttgtaatttttgagaacagggtggaaaagcactcatttaagtggaggatttttcttttaaatgctgtacttgagaatgtatcattattccagatgagacagataagacgcgttgctcccttgccctggcagtggatttgtttgtatattatgctttctaactctctttctttgctgagctagctattttatgtttctttgtgaatgactgtaccttaagggaactatattctgtatccattattttataaaggtgagtgggctcagtaaatgcctgaaaaagtaccttgactaagatcacagagttaacataataaacctgatagtgctgtaggaagaaagacctagttaggtgtggagtaaaacttagccttataattcccaggccaaagtgtttccaccatcaccaaatcagcgtcagtaactaatcaaataacaatttatttaagccattaaaaaatgtaatgctttcactgcaatgtgaacatatatttaaacatgatgacgatttgtaaaaacaaagatttttagaactaagaagaaatatatattacaaagtagttagtattaaataaactgtttcctggatcctgaatgatgataaaagtttaccccattaacactagggagcatattcaaagaatccaaaattctagcaattctttggtttagtagaagccacaagaagataatttatatctgaaattctgtaatattacagcatcccagttccttttgtgaaacccagagttccatttactcattcgaatggctatacttttttagaatctcttcaaatttgttccatacatactttttagatatgaactaaaattaggcagagtaatatagttttctcctcaatatggaattgaaaaaagaaatactccagttacattttccagctgagtactttggcttattattggatttgattttacctttaacagtgatacaaaggcaaatgcaattgacaaagttaaatatgtggtagcagagtttgaagtttaaaaccctacgtgcttgcttgcttgcttggttttgcttttgttttcttgagcaattgttgactactcagcctgctctgtaaagttaagagcatagactctggagtatcagatgtagattagaattctatttttgccactacctatatttatgaattaaaacttttttttaacttccctgatctcagttttctcatactttaaaagaaatttatgtgtagacaaggaggggtcttactactctcattagcaataaataatattattacttcattgtcaagtttcctactacctaggtacatgaagcgcccttgctctgtctctctttctctctttctctcctctctttcttccagtttcctttatttaacagcaagttaaaaatgcagttggagaaatcaatttattattctcaaacaatttattttacatttataaaaccgtagagatggcttatattgtttatgtgacattgtttatccacaggataaaagaaaaagagttaaacagtaaataattaaaattgttagtttatccacaggataaaagaaaaagagttaaacagtaaataattaactcccacagctatagtcattcctctttaaaaactctagtcaactaaccaaaggaaacacctttttggtgaatacaggtaagttagggcaaagttttggtagtgaaattgtaaagaatcgattactactgtgatgaatcaaatcataaagaatttaacttcactgtactatacaatctattttcaagttgaaagttagttaaaaatgtttcactttattttctttgaagacaataagttggaggcaattcaaacattttattatgaattatcaactaagtttatttaaataatgaatttatctttatgcttaatgcaaattgcatatacattgtattcaaaataaaatgcaaataccaaagaaaaattgttttctaaaataatgttacaagtttatatttgtttcacagtaaattatttttaaatttttgtcagtttacaaacaaaagattgcttaacaattgcaagcagcaaatttaccaatatataaaattcaaaatgttcttccaaacacaaatataattaagcagcaataaaagcttagtatatgaactttattaatagtggttatatctagtttgtagttgccaagaagtaccagctttacatgcactggcaacagtaataaacaatttatggctttctaataaacagatacgtgttaaaagcacatttaaaagaaataccagaagagtttataacatttagcgagcatatggtctctataaagtagtaaattaagtactttataaaactgttagtattaatactatattacaatattttatatttgtgctgcatagttttcaaagtatcatttagaaggattctaatatttttagaacttatttattcttcccaactttgccagataagatttatctctactatgttgaagaattaaaactgagactcaagatggttaaaattttgactgacgtatttcaccacttggtaggagggccaggactcataattaggtttgtgtaattctaagtcaatgattgttccagtttatcttgctgttgctcaaacaggtgtgcttttaaatttgcttataaaatatgcacaaacagatggcacctgctaaatacataactggcaataatatcttgatattttcaaatactcaagagtaatctagcacaaagagctcagaaatttgcaacacaatatattgcacccagaaaaaacccttaaaaccgtctagttcaatcatctatgttagagaaaaattggacaaatagaattaaatgtctagccaatttactatctagaaaatttcaaagttcagactcaaaaatcacttctttgaatccatttctagagctttctgtgttacatcaagaaaacagatttttttccaaatgtttatgtttctttgtccaatctaaaggatgaaagatactaattctctgtaatacataagaagaaaagagaattagacagtatctttatcaagtcccatcagattagcaacaaatttacaaaagtgatgttataaaactttttgactaaaaggctttcccaatattataaaaagggtatcacattatactgccatttaatgctattaagaaaacattacctactacaaataaatcttaccgtcatgtttctcaatctattataattaataaaatattaggaaaagacttgttttattgtgaaaatgttattcaatatattttattccagataaatggatattaaaggatatttatagtactttcaatttgttctgaaagctacatctgtattatcaggaatatgtataagcactaaacattgttgcagaatttgtctaaggctaacaccattttcaacaccatgaagaataaaacaggccgggcgcggtggctcacgcctgtaatcccagcactttgggaggccgaggcggacagatcatgaagtcaggagatggagaccatcctggctaacatggtgaaaccccgtctctactaaaaattacaaaaaattagccgggcgtggtggcgggcgcctgtagtcccagctactctggaggctgaggcaggagaatggcgtgaacccgggaggcagagcttgcagtgagctgagatcacgccactgcactccagcctgggtgacagaacgagactccgtctcaaaaaaaaaaaaaaacaaaaaacaaaaaacaaaaaacaaacaaacaaacaaacaaaaaaaaacaataaaacaattttcctatatgtcagaaaaaacttctttacagcttttatgaagtgtataaatccctgcatgaatatattcaactcagtgactctattacattctttgatgtccctcatgtttctaaaaaaaatgatgccgagtgtatctttaggatttgaaagcaatgaaagtatataaagccaactgacaggacctcacttatttcctgctggtttatcagccgtcaggaaggatttgcactcaaactcttccacctttccccccttgttatcaatggcatacatggagccacaggaagagtaacgcatagtgtggccatctaaaacagggtaaaattcagacagtcttatagaaataaagtcacaaatgaggttcgaaaataattaccaacagacacaaaagaagaatctttaaaactccatgatctaaatatatattgacaatataattctatgccaatgagtagttttgaattcagcaccatatactgactgcctatttatcacatactaaagatacaaataagtaaggagttacccacatataaatattccatcaatgtttgcacatccatggtatatattataaagatacatctagcaccagaggatgttgggtgctatggaataagaaaatagagacgtgatttttttttttattttcgagacagggtctctgtcacccaggctggggggcagtggcctgatctctgctcaccgaaacctctgcctcccaggttcaagtgattctggtgcctcagcctcctgagcagctggaattacaggcgcatacaccatgcccagctaactttttgtatttttagcagagacggggtttcaccatgctgcccaggctggtctcgaactcctgacctcaagctatctgtccacctcggcctctaaagggctgggattacaggcgtgagccaccaggtccggcagaggcatgaattaaaaacaaacaaacaaacaaaaaaaaaaacttaaattacattctcaccccatcaacttatttgatcttaccaagtcatttcatctctatcttccattttttaaccacagtgtaaaaacatttgacttttcttcccactatattgttgtaagtataaaatgccacaatatatgtgaaaatggtctgaaaatcctaaagcacttctatattgctctatatacactagagcaagaagaggttaaatggtttcccctggtagcaccttcctgagcacagaaaggtgacctcggcaccagggtgtactggctcacttccctaaatctggaatgtaatctgaagagtattacccaaatcctttttctattgttttttttttgttgttgtttttttgtttgtttgtgtttttttttttttttttgagactgaatctcgctctgttgcccaggctggagtgcagtggcgccgccaccacggccggctgattttttttttttattattattattttttatttttagtagagacagggtttcaccgtgttagccaggatggtctcgatctcctgacctcgtgatccacccgtctcatcctcccaaagtgctgggattacaggcgtgagccaccgcgcccggctccccaaatctttactgccaagaaaagtgacaggtttagtaatttcatagtggtttggataatttggctttcaaatttcctttagattagttcctttagattataacattgctaacactataaaactctagtttgagtgaaattcttgtggattcagatactgcaatcaacgaacattgagccaaggatgaattggtgctattcctggtcaattctctttggcaaataaagatagactcgttccatgattgaaagctacataaaaaatatctaatatcactacatatcaaatataatttaaaatataaaatcaaaattaagtccttattaagccttggtagattaagaaaatacaccattaatatgccgacacacatctaattattaaattaaggaaaatttttgtatcaatttttgattggtaatacagaaataaattttcactacaaagaaattttgaataagtattgacactgatataaagtacatcatttaattattatcattattttttcaaattttagttatatttagaagattagattaccttagattccaattcaaagactatatcccatatgattatttcagcttttttcagaatgcattatttaaaaaacaaaacgtttatggacataaccaattataatgtgctgctgctcacaaaacaattgattataaacatgccagaaaaaatgacacaagtcgcatatgtgttctttccagattcaagctattatcttctaaatattctaagtagatagtagattaagataatttatttgccatgtttttcacacttagagtttttctttcttttttttttttttttttttttttgggagacagactcactctgtcacccaggctgaagtgcaatggcacgatcttggctcactgcaacctctgtctcttaggttcaagcgattctcctgcctcagcctcccagtcccttgccatcacacctggcttattttgtattttcagtagagacagggttttgccatgttggccaggctggtctcgaactcctgacttcaggtgatgcacctgcctcggcctcccaaaatgctgggattacagccttcagccactgcacccagccaggtttccctttatgcagaaagcagcttgcaggcaatgctaatattggtttaattttcttaggaggaacccagtatagtacgggaaataattaatataatttgttcttaaaaatatagcttagtattgtattaatttttctagagactgagccaaatcaagtttattccaactaaaatactgcaaacatttacttaagctaatatgtcttattcttaaaatgcttaagggtgcagctctagaattatatttcttagtcacaccttactgcaaattatattaattggagaataaatttatttataatcctagacacgttttaggaagagaatttgaatggaataaacagggaagagaaagatacatcttcttatgataaaataaagatactagagatctttatgacacaatagtaaacatatatatgaattatgaattaatctaatcatgctcatacataaagatctaactgtgtatttttcattttaaatcagttaaattagttacataatctactgtataagattaataaaaatgaactaaaaatatctgttggctcatcagaataatgcagcacttttttcattgggttattaaggataatatttataataataagtgcatacaaagttcttattacagtgcgtagagcacaatggatgctaactggatgttactttctctctctctatcgtgtaaacaccatgagacaaggcgcggtagctcatacctgtaatcccagcactttggcagcgggtggatcacctgaggtcaggagttcaagaccagcctgaccaatatggtgaaacccccgtctctactaaaaacacacacacacacacacacacacacacacacacacacacaaaattagctgggcatggtggcaggtgcctgtaatcccagctactcaggaggctgaggcaggagaatagtttgagcccgggaggcagagtttgcagtgagccgagatcacgccattgcactccagcctgggtgacagagacagactctgtctcaaaaaaataaaaaagtaaaaaataaaaacaaaaaatagtaaataccatgagtgcaaaaagaaaagctatcttattactgacgtgtccctatcctttatatagtgtccattacgtaataagagcccatcagtcatttttttcaatatgtaaatacggagaaatatcttgactacagtgcaggactccatgtttgtttggctctctgctcaaattagacttttcttccatcaatatagaataagccatgcatagacatagtttctattaaaaatctgtaccctaatgagtagaatgggctcacacagatcttggaaaaatacatttagtaggcttggtgaaactgtaatggctttgtacagaactccactgcaacccacctgacaaactaggatatgctaaacaaaccagtcatttatgtgagcgtgtgtatgtgtatgtgtctttctgtctgtctgtctgtatgtatgtgaaagagagagagagagagagagagaaactatggatacttcctttataaattctggctttgccttgccttagaacaggacaacagacttcacaatttttctacatatatgcaaataaattctcggcactttaactgtctttgagttacactttgatacatccacagtgcaatttatgtcaataaaaatgaaattcctaagtaggagggagctgtgtcttaacgtgattagtatttggacttcctattattgtatttgaagacagaggatgcttggctttatgaagcaagctcccaattggattaccatatgtctcaaaaaacatgatagtaaatgtcttttgatagcatgagatataaaggagaaatataaaaatttgctttatgaatgttctgcttccagccggggtatattcagttgtagttaagatagttgtgttctattagctggggacaatttgtaactgtccttattagaaacatacatgtgtatgccaaactgctaagaaatgagaaatttctgtctatatcacctgtttttggcttgctcagaattctaccttttttttttttttttttttttttgagacggagtttcgctctgtcgcccaggctggagcgcagtggcgcgatctcgactcactgcaagctccgcctcccgggttcacgccattctcctgcctcagcctcccgagtagctgggactacaggcgcgcgccaccatgcccggctaatttttgtatttttagtagagacggggtttcaccgtgtcagccaggatggtctcgatctcctgacctcgtgatccgcccgtctcggcctcccaaagtgctgggattacaggcgtgagccaccgcgcccggccaattctaccttcttaaaaattggctttcctttagaaaactacttcatttgccttctttatggtagtcacagtgctatgcccaccaacaatgacaagtaagagacctaaataagaccaattagattattccttaaagttttatttatgccgagagagagacagagagagagagaagggctcctttccttagtaattgcaattatgaatttaggttgagttgtcagcagccttaatatatagctgcatggacaaatattgactgagagttaaagccaaacatcatgggatgcaagcaaaaggcatcaaaagaaacagattcctcaggaggtcttattgggtctctgaatacagccatgcctgaaaaactcactgtaagacccttcattgctttatattatttgagctgcttttctttcccttgtaatcaaaggaccactgacaaatactggctaagtagaatattaataagaatatacacgaaaaagaaaaacatgaatatgcttttggtataaatttacctaaaatattttaacatgcaaattagataccatgtagtttgttaactttaatagttcctcaaattaaaatgttttagtatgtaaatacagatggtttccaactttaaatggttcgacttataattttttatttgattgtgatgtgaaagccatactaattcagtagaaatgtttcatcaaattttgaattgtgatattttccaggctattaatgtatggtaaaatactctctcatgatgctaggctgcagaccccagccagccacaagatcatgagtgtaaataagtgatactctacagtgtattgtgttgctgacgctttttggatattgtcttttcacatcccatcatgtttacaaaatggcatttttgacttacagtgttgtaaatgtatgatgtgtttatcaggccacaactccatcataaatcgagcagcctctatatacacaatatgtatataattttgagtatctcttcatattaatgtaaagttttattttacacttcatttgtggctacttttttcctttaaataaaggcaatgaaaccagatcaatgagagtacttgaattaattctagttgtagaaaagcttggatgatacccttacaaaggaaacccaaataaaaacctaaccaattgaacttttgggttgtgtttggaactatctcttttcaatgaattaacatgtgttatgtgtttatgatgacaaatattagactatattctttaaggcttatcatcagcaaagactttccgggttataggacttctctttatgatttcatctttccaatttttctgacttatgcctgtattttcttttatctttgcctcctataggtctggcttcttctgtcctctcatttcctggtctcctactgactcgcctcttatctctatggcatgtgaccttgggcatgtctttcagtgcctgtcattcttcttatacttcacttcctgtctctgccttccctccccctccatcttactacttctcagcatccttatatacaggtgaaataaaatcacttaaaattatcaattagatttctagtaggaaattgaaaagtactatcatcattttctttataataaagaatgtgacatgatatttaaagaaaattatttttagaagtgttcaattccacttgaacactaccgggcaaacacctaaattttcctttgttcaggttgcaaaatgtgagcatttcctaaatttgctgtgaaccctcaggaataaagcaaaaaacaattttcaaaataaaaatgaacaatttaatagatttaaatatgaatgtttcctaaaaaggatatattaataaagttctgtactaatatatataaatcctaaataaatttccatttcaatacttccttttgatatttctgtcttctctctcttgatatagaaacaacctgcatgtatgcagttcagttccttaggcatatatgattcattcatcttaatttagaaaatatcaaggccatgcctgggagcagaattggggcattatttgtctttcggcagcgtatttttaaaattgttatgaataagtaaattgacaaaatcctttctaagatgtacagacattttcaatcaataatgcacactatcaggacataaaatcttccctaactttttgagaaatctttacgttttctttagggaatagattcacacttaggttttatcacctatcctacactgacgtttgggggctgaactttttgaggtaatgggtgcctctgtacagctgcaacccagaatgattctttcactactatgccctgagcaaaaacagtcttgggttacaggagtgaattagtgccttctcctgtttcctgcaccctttatttcatgaccttatcccatgtatagggcgagtaagagtagtcagttcatactgatctcagcagatagcgatataaacagatacttggctcatagggcataacttacatttactaagaaaatgctcaaaaccattcattgaagtttttctatacagactttcaggaattttaatgagtacttgcttataaaatgttgacaaccttaatcataaagtggtaaaaactaatatgcaatgtatcaagggaacaatacctccaactgttttcccagaatatactttacaaattaccaaagcagataactgaccacatttcctttttaatttacctcactagttctttgaagttctattcaccattagctctttgaataactgttttaaaacagatgggatgaacatctggataacacaacatatatattttttttatcaattgcctcactgatgtgaggaacatctcctcccacacacaccaccctgtgcctcatctaatgtgttaacactttggataatgagaacaacagaagtggatactaaatatcttattcaaattaactcaaatctgagtgcaaatgtggaagtatccatgcaattcacgaactgctgccccagactgtgtttttaacagcagtgtttgatgatgttggcactcttgatcattttctgtttttgaagttactgagttcaatgatccatcctttgtgtttatttatcaggactgtgaacatcacaaacaatttgagatgtttagaattaaatgttgattttagctggcagaaaaaatgcaaagttaggtaaattgatgagcatcattttcatgtatatattatctctttgttaacagttatctttcccagacataatggaaatggctgaggagtatgggtaaactgaagtatctgagttcaaatttatgcatgttaagatagaataataaacatgctactcttctgtgcagaaattcaatgccaaactaattcatgaaatactgtacaatactatacaatacaatatagttcaactatattggctcgaatcaatataactggtagtttaagtcactggtagttcaaagaaagaccaactagattctgagcctcaaacagcattattagggacttgcctgcctctttgtctggcttcctctacgatggcttacttttcaggctgggtttcttaataatgttggtaaatatgatcacaacaagctctaaaattctacactccttgcctttctgcctgaatcttgcccccccaaaaataatttatttcaggcacttccagtccaaattttaaaactgatactaattttgtgtagtttgggtcatgtttatgacctactaattagtcacagttgccaagaaaccgaatgacctaggtaatatgctcaactctgaagctaggctatcaggttttgaaaccaatggattaagaacaggtaagtagctgggcgcagtggttcatgcctgtaattccagaacttgcgggggccaagacaggtggatcacttgaggtcaggagtttgagacccgcctggccaacatgggggaaaccctgtctctacccaaaatacaaaaattagcctggcgtggtgatacacatttgtaatccaagctactcgggaggctgagacaggaaaatcgcttgaacctgggaggtggaggttgcagtgagccgagatcatgccactgcactccagcctgggcaacatagcgagactctgtctcaaaaacaaaacaaaacaaaacaaaacaaaacaaaacaaaacaaaacaaaacagttaaggggtaattctccaaaggaaaactatcattattttatcaaactaatgaaggaagcatgctggtcagtcaaaccaacctgtgtctataatcaaagtgcaagctttgcagaggagcttttaatacataactgaaatattattcataagtaattggagtattctggggaatagatattagtaaaagttaaggaaatagaatgacaacaagtgataacaacatatatatatgtatatgtatctcctaacattagtctaaacatagagtccataccactgacagcaggcactggacatggttagaggaccattctccttaccataaagtgagaactcagatatactctccaactaatttaaccttgaatcacattttacctatgtatgagctatagcataatgtcagagcatattaatcataaccatatagcaagaatattacagattaaaattgtcatagcttatttttcttgtcttataagaaatgctaattagggtgaaattcatgttataaaagtatttacatataaatacttcaagaaaaaatttgctggagatattagcagaacatgtcgtacttaaaaaaatgcaagaatttggtctaggctgggttgaatatgtttaggaaaacacagtcttttgaagaaaaagtagattgcaatatctcaaataataactagtgacaatgaagaaaataaagtgttcttatgaacataagagttgatatttgtaacttttatggcatagctgatgaatcattcagtaaaaccaaatgaaacaaataccttcaatctctcaaatcaaacaccatactattgagattttagctataactttatgtttgtcttgtttgaaaaaatacttcaaaaccccaaaatattttttgttaaaccatcttacatggttaaaacattccttttagagtaaacacttatgaaattcttaagcattgtaacttcatcattctaaaggattaaaatgtttattttaaattgaacatttatgaaatgcttaagcattttagctagccttttttaaagtgcaatcataaaaacaatggttttataatgaaagaaatatttcataattgcattcatacatttgaactgtttatacatgtggcaataaaatgaaatacaattgtgaaacacatattttatataaagtatagttgccaatgtttttgttttcttgaaataatctttttattctttttcgcttttaaagcataagtttgtgtcacaatttaaattcattctagaaacttgcagttaatccctgattacttgtcatgattagatattcagctaaggtatacatcacagaccatctgtgagaggacactatttcatttgtcttctgggtaatagggaggctcattttgaggatgaacccaccctgctcttttgtgaaagcaggagagtgccaggtggttggtagagataaacacaaagggtaataccggggaaaaagaaacgcagggctttcccagcaaacctttacaatattggtgcactacaacaggtggaaaacagtgagatgtcatatatgtgtgcaaagccagaacacatttcacaatttgtagctcagattccatgagacactaagaatacagatgttaggaagtttcaaatttcaataagggtagaatgtaataccaccttgaaaataccctttctcaactgcatgtacttatattgctaactggagaaaataactctggagagtaatcatggaactgtgtggagtttatttggttaatgggaccaaacatacagttaggtagaagaaataagttctagagttcaatagcacactctaaggtgactagttactaattcattgtatatgtcaatatagctaaaagagaatatttgaaatgttcccaaaacaaataaataataaatctttgtggtgatggacaacctaaatatggtgaattgatttttacgtgtggtatgcatgtatcaaaatatcacatttactttttatggatacataagagttgtactatataaatatatatatatatagtatataaatatactatataaatatgtacaactcttatgtatccattaaatgtaaatacatgaatagattaacaaatagaacaagaaaaaatgattagtacagaatatttagcctttttctaagtttcatgagaaatctgcagatttcctagggaaacttatgatagcctattaacatgcaaatataacgtattagatctaatttttaaaagtaaaaagggatttttttaatcgactcgaagaagaaaaagatcttttaccatggttttcttgtcctgggctcaacatgtaatgatgaaagcaaactagaatagaaagtaaggcaaagaaaaataaatatatatttttttcagtggtctctaaatgtcttataaactttgttatgtctcttgtctagctttattccaggcacaaactgatcaaaaattggttcactgaatgagcttgccatatcagatatagaaattttgagatttgctaattcaaagtacaagaacacagtaaatagtaagagaatacatgagcctgtgagtatattaaattcactggcatgttttttcatctatttccctttagaatctattacaaaacctagagaaatgtgactcctatgaaccactgttatgcaaaggtgtgccagattcattgtgtttagggtagaaaatatagctgggagtaagaaaataaaaaataaagattttaattccaagaatgccccaaactaagtaaatgatgtattaccaaatttttattgctgcataaaatacctctttgtgacaacccagtttacaggcaatttcagtgttgactattagagaactattaagctgagaaggtcatgtagcatagggtaaacctcatgacctcatctgttagaacatgtgttgatacgatagaccaaggaaaaaatatgctctgagtaagaggtaagcatgcaggatcaattcaaaatggtcccagatgaagatgccttctgagtatatgtcagggaagtgaagacaatgaatagttccatgcaagcaattcaagtgagaaagggcaatgcgtaaggcaaaataaatgagataagaagcaactgttgccctcaaagagcctggtaagaggaagaatttttgtaagtcttgcttatttttcattagaaaaaaaatttagaggcaaatctttttatttaggcatattataaaaatatttctgtatcctaactatgaatgagaaaataagcataaactcaaattataaaaagatccaacaggcaaaaagctatgacatacaacatttgtttgaggttgatacttgaaaagaaattacccacaagttgtggagaaaataaatagaaatctgtttttctccactgctttaagaatctatactaatttcaactctcttagacaaaatttcacataggccacgtgcataaatatttttatgttgccattataccttatatggcaagtaattcctgtatccatactaactttactctgttgagctaaatacctttttagcaaaaaatagaatgtatcaaaatcgtaaatgctgacatttattgggaaaatggaataaattacatgcgctataattctcaaacctgtttagtgcaaaatatcttaaaagatgaaaaaagttcagagagagcaatcacaaatggatagaaaggaaaattcaaaatgatgtcaagaaaaaactggaatattagctccaggagagcaaaaacttttgtcttttattttttaaactactctcaccctggtacccagaattttgtttggacatagtaagcactcaatagatttagtgaatgagtaaacacattttaaaacatcaaaagtattacctgtattacagtgaaaaatacctaatgaccttctacaatgtgccattctttatgcaaagtactttatatataacagcctgtataatcactgttaaaaccacagagaaagataatcatttattgatgagaaattagaagttcagatctattaagaaagtcatccaaagccatgctgacttcaaagtacagactctttactttaggacatggcataacctccagagggtaatgatattgagaaagctttgccattggaaacacaatttcatagacaagaagagaaggttatgttcacattacttttcatgcttcacatggcaataacattctgatctttaatgttaggatttataactttacactaaatactccatgatctgttgtctaaatggtaacaccaagaatcatcacttttcctctgtaataagatgtgcagtgtctttgtgtgaaatatagctatatacattgtatatcttctagttgagaaaattaatcatgcaatgtatctggaataagaaaaaaatacagcaacaataaaaataggacaataaaatgagtaatacgtttaaatttctattgccagaaaaattgttcaaaatagaacttatgaaagagaaatagtgtagcacaaaacaacagcagaggagaaatgatgaaaacaatgagagaaagagataaattagtgaaataaagttgaaaaaagtttcattttaacatcattgcattttgtgaaaaaattttacacttttacattaaagagtttaagcgtatactaaattgaatttcttacttgatgcttctgctttaaattatatcaacgcttaattaccatttaaagcttattattagttaatttatatatcattactaatgtcagcatcttgtcaggcataagagttaaatataaatttatattccccaggtgaatgcaattgatacaagaaaaaaaaaaaggagttcctttctctaaatgtatcacatagtgatacaactttttatacactacaaatagactgggtcagaagttaaaaaaagtagtttgtagggccaggcgtggtggctcacgcctgtaatctgagtactttgggaggctgaggcgggcggatcacaagatcaggagatagagaccatcctggctaacacggtgaaaccccatctctactaaaaatacaaaaaattagccaggcgcggtggcaggcgcctgtaagtcccagctactccagaggctgaggcaggagaatgacgtgaaccccggaggtggagcttgcagtgagccgagatagcaccactgcactccagcctgggcgacagagcgagactccatctcaaaaaaacaaaaaaaaaaatctatccactatacacctttttgtgttcttaatataatcttcccactgaatacacaatcatatttactaacgtctataaccataaatgctatattttaacattatagacttagtagggttgttacttaaacagaatacatgacaacatcttcatgttctctaatctgcagacaccttttcaggcttttgcaaaatacgtaactgtttggctcaaaatttattacgagttcaaaaatatttttaaatactgaatacaaacagagagtattgaaaagctattttaaatattcaagaggactggagaaaactcctccattaattttaatgatgaaattaaaactgaacctattaaaactaaacctattagtcatcaagaatgatgattaaatgaaagtatcaaacagaatctatgagtccatgctaataagtgtttagatcaattaataaatgagggagtagaggaaaagcctcccatttagaagaattccaattaaattacatagacagtccacactaaaggagggaaagcataaatccttacatcttaagtgtgccctggtgtaagaaacttctttcctaagagtacagtatgggaagggggaagaacagtgacatcacagttgagaaatccgacaagtcctatttcatccaggagatcaaggtcaaatttaatagtcataaattacattggtagtatgtaccattgatacaatgtgaggaaaataacaaattccctctgtaatatacctcccccaagcactagtcttatcaataggaaaagcaccaacaaatcccaacacatggtatgtattctacaatatctgactagcatgcctcaatactgtcaaggtcatcaaaaacaaagtccaagaaattgtcatagccatgagaagcccaaagagttaggacaactaaatgtaacatagtgtcctggtgccaccttggtatagatagaagacattacataaaaacttaggaaatatgaataaactatgaatttcagttaataataacgcatcaatatttattatctaattttaccaaatataccatgctaatggaaaaatgttactaataggtgaacctgtatgctggggtcatacggggattttctgtacaatctcctctatttttctgtaaatctaatttttttctattaaaatgtctattaataaaaataacttaaccaaagagtctaaatatgaatgtgattatatgcaggtctgaagggcataacagcatgagagcatagagagaatgcaaattacacagtccagaggatttgacaagaagtcttcttgctttgcaataagctgcttgggcacacttagataagtcatttaagcctcttttccctggtttgctatgaaatgaatgaacaggactacaagagttctgaggccccactgagctctgttgtccgttgatttacctacaaaatgatgtcaccctcagagagattacaatctacttgagaaagtaaacttgctaacattgaaacaaatcaaaacatatttaggaacatagttcaaggctgggatcatattctatgtagttcatattctcaggatttcagagaaactaagcagcattatgaaatacttaagaagtaagcgagacttaaggaccattttgaaaaattggaaaatatgaatgaagaagtgaaggacaccccatatcccaaataattggaatctgactcttacagcaaattctccttttgcttcagttttaggttctgaatggggtaaaatattccttcaaatccctctatgctttattatcacatatagcatgaaacccaagtgccttacatggtgtatcccaccttccttgacattgtccttgttagttttccaaacccatgtcatgccacttgtaaagtgatctgcattagcacagtcctgagctgtctttagtttcctgcacagactatagttttagtttgaaacctaaatagtgttctgtgccaggacaggactctgtctgggaaagaagtgtaaaacttttggacttggtttggaaatgctcgttcattttaattcctcagtttgttttgattatctgagcctgcagaaatgatgcacccaacatttctctcaatcattcaaatgatttaaaacagatgaaatttttgtatataatatatcagatttcagtgagttgttaacttctgtataggagccaacaggaattttaaaaatctgttgttaaacactaataataatcaaagttgcaagacacttcatgttgagaactacaaagacacagccatagataaagttaacagcgacctggtgtcactgctcactccagggtgtaagcttattgaatagaatggcaggcatgcttgacagcagagtacgcaatgcctttttttttttttttaaatctcccactctttttctattttatcaagcatacataattaaatttgttaagtgaaaggatgcttaaaacacttgcagggatgtttctcaggaacatcctgagatttttttttttttcaaaaattagtgactttaaagaaaccagcatcctttgcaaactcaccaaattagtgtgtgcgtcaccaagatagaccatattttcttatgggtgggatgctagcatgcaacctgggatcccaaaatgtgatatatttacaggaaacatcatcacaaaatgccatgagaaagcagactgtgtacagaatccattctgctaaaggtggcatcagagcatccatctttgggaagtagttgtgacaaagtttctagaatccagtgcctgagggtcagcagtccagctctggtgtctgtatccctcaacagtatttcttcctgcataagccagttagggtgaaatctgttctttgcaactcagagcactgatagacaatccttcttttcttctggtgatacgtttctctaattctttagcaaatacctttttgtctgtagttctcaatttttggttccctccttaactgaaagtaaaaactaatactctgttgtccagtattgtagtctaaacacatatgtatctatttacattaaattagttcaaattgaataaaattaaaaatttacttcttcagtcatcctgaacgcattttaacggcttaatagcaacatgagctaccagcaacaacatcaaacaatgcagatacagaaacatttccattactgaagaaagttctatcagaaagagctgctctaaggcatagaaaatttgactagggcatatgtttctgcatctacatcagagaatccccttttaatgagttaactgattctgttaatggtttcaaattatgaccttgataccatgacatattacattcatctttcactctattattcattttgattttgcaagtaagtttacaaatgatcagattagattcagagctcattttgttagaataacaaaaatttaatctcattactactcattcctaaacattgaagttttcctcccagttaccttctcatgaatgatattaaactccagagtaaaatctgaaggctgacactaacagagccatccttttcagaaagtacatccaactatgttaaagtgttcattttagttcaacgatacctgaaatgcaggctgtgaggtggacatttaggatatgtacctgcctagcatacatttcccatccttttactaagagtactccaatttttgaagtctcccctagtatacaaagtcttggtacttctgtcagtcaagttattttctcactctcccctggccttgtgcttgacttaggaaacaattaaccaattggattatgctgtagaaacttacaaggagggaaattaaatgaagttacttaatctcaacgaaattacccaaatatatgctcatgagttccccttcactagacccccagagctgcccttattttgtccttcctgagttttgattgttcaaaatttactttgcatatgtgtcctcctgcaagattttaatgataatttttagattttgcttttagaatagccagttggcttttgcaaaagtattagatgatatcaatgtgcccatatttttacctacttgggaactttttcaaattacatctgttcttgatattctgaaatgccacgcttacccctttcttatctgtcttggtagcctaccacactattgacacactcatcatgaaccagataggtactttgaattcatctgcctgagaataatttaaccttcatggtctatttctgccaaaatactgctttaatacccccaatatttgttaactctatttgaagttaaatttctatctgtttgtgctttgagagatgttggcaaagagaaaggaggaaaataaactattttagataggcctagccttgtcaaatgtgttggagactttatagaaatcatgttgtcaaagtgatcaatttaaagaaaaacatacttatgtcttcttattttctgtatcaggatgtaactgaatatcttttggttagacatttgatcatatgttattttcccaaaccatcatttcaaggttattatcataagacaaatcactctaaaatctaatagttcaagccagtcagaattgagtgatgaaaatatacagctttatttataagtacattttatcattaggcttgaattggttcagacgtcatgaaaaattttgcatgctagtagtaattcctcaaactccaaagggattagagtttaacaaaattgccaatccaaaaaaaacaccaagcaaacagacatttattttaataagtacaaattacacataattataaatattccttatactaatatttaaactcagcagacagaggacaggttgaggtttgatttatattcacacttccgtcttaaaattttcaaaagacatcttttatttgcttacacatgaagaatgatcagtatcactatctgaatataaattaataagtgaaagtatctgtatatgtaaattcaggcaaactcaggcttaaaaatctaccttattgtaccacattgcaaaatagaaaggattgtaattctttataagtattcggtggaattaagtgcaatgcaaaacatgctatgaatgtcagctgttatatggaaaacatctaccagaaaagccacccatgagtccactcagataataatttttcctcttgtctgttttataagctgttgaggaatatataaaagaaatggaaatttacaaatttcaaataaatgaaacatacatatttttatagctatataatattacatacatttaaatagttacttgtattttattggctcttcggctacattccaaaacttaagcaagttaatttaggaagagccattaaatgcacgttctcaggcatattttcctacttgtaatgttcatgttcaaacatatttttcaatatgtaaaagtaaagtctttgtaaaataaataatttaagacattccttgtattataactgcattcagaatgtataatacaattatggcttggaaaaatcaccttaaaattttgtcttatctttttgttgtgcagaagctccactcaaaagaagacatacatgcgtccaacaaacatatgaaaaaaagctcaacatcactgatcattagataaatgcaaatcaaaaccacaatgagataacatctcattccagtcggaatggctcttattaacgttcaaagaaacaacagatgctggtgaggttgtggaggaaagggaaagcttttacactgttggtgggagtgtaaattatttcaaccattgtggaagacagggtggcgattcctcagagacctagaggcagaaataccatttgactcagaaatcttgttactgggtatatacccaaaggaatataaatcattctactataaagacacatgcatgcatatgttaattgcagccatattcacaatagcaaagacattgaatcaacataaatgactatcaatgatagactggagaaggaaaatgtggtacataaataccatagaatactatgcagcataaaaaggaatgagatcatgacctttgaagggacgtggatggagctggaagccattatcctcagcaaactatcataggaacagaaaagcaagcatttaaagtgggagctgaattatgagaacacacggacacatggggaacaacacatactggggcctgtccaaggggtggggggcagggagaacatcaggaagaatagctaatggatgctaggcttaatacctaggtgatggtatgcatctctgcagcaaaccaccatggcacacatttacctatgtaacaaacctgcatatgctgcacatgtaccccgaacttaaaagctgaagacttttttttttcttagagggagaaactagatctaaatgagtcataaaatacaaatgaatacaaatgcttaattctcctaatacgtcatttttaataaattaaaactatgcttatcagttcatgtgggattgtctaaaaattataaatgaaagatttaaattctctaccttcacaaatcaggtacagctagcattgatgtcattgagatttggctgatggtacatcattagattctataattaatcaccaacacctgcagatgcattctcaacatgaaattacttttgatatcacatggagaaggagagatctcactaaatcttttaactatgagtactttggaggtaacagagatgattgtcatcttgtcacactgagacatgttgattctagcacttttggattcttccatgaatatgttaaaccattaccaataggtcaataacctgcccttttcacccctgactagaaacactattttaaaagagttcttattgatttttttctagctgtttttatttttctcactttctaaaataccaagaaaatatcattcaatgctgcaaaaataacctaaagaaaaaaaatctaggagcatcatacaataaaaatgaactgatttcttatgaagtcagcttcaaaactgtgtaaggcccaattcttatctctgacaatctgttacttaacatttgctgcttaacacttcataaaagtcaagtctagatgaactggcatacttcataggctttttttttttttttttttttttttttttttttttttttgagacggagtctcgctctgtctcccaggctggagtgcagtggcgcggtctcggctcactgcaagctccgcctcctgggttcacaccactctcctgcctcaacctcccgagtagctaggaccacaggcgcctgccaccacacccagctaattttttgtatttttagtagagacggggtttcaccgtgttagccaggatggtctcgatctcctgacctcgtgatctgtctgcctcggcctcccaaagtgctgcgattacaggcttgagccactgcgcccagccacttcatagtcttataaataatttactgtaatactcattaagggcagtaaaacaatcagcagttactacacactgacagattcaagtatagagtgaatgagatactatgtatctactatatcttgaaactaaaacataaataagtgtcacaaatttaaaatatacatttaaaaaagaatagacacacacacaagcacacatacatacaatcacatacacatccaaacacaggcgtattgttatacatgcatataaattaatattaaataaaacttatgttttaacaaactctgtatacttaaattcaccagtggttagttatcccaggcagtattacctactaagccttagggaccattattttcatttaaattccagtagtaggtaaaacctaaatgtcaaaacttagcacaatgtttaatgagtggataaatattagaaaccacgtctcctgaaatcttaggtaagtcattattaggggcttactactttcagtacctgacatttactcctttttttcatattagttttattttttattaaatgtcctcctgccttgaagataatctatttaataaagaagaaaaaaaagtgcttttttactttgaggtttacttgaacataagcatcacctttgtaattccacacaagcgtcacctttgtaatttgtcctttaagacaattagactgttttatatcaatgtattattaaacttgattgcacttatgcaggacatattataaaagaattatgagggaagtacacagatgctgttagagtctactaaaaaatagattatttactattggaaacccaaaggagagaatgcctcaaaaatgtggtaataaatacctgtgggaaaatcttaagttgaagaataatcctggacataattttatttactattgttattatatctttatcctaacgagattaatgactgatgttttcactgcaatttcagttaataggaactctatacaatgaaattgcttgatcaactgatagttttttagtttattgttttattgacacataatagttatacatgtttatggagtacatagtgatgtttagatacacacaacgtatagtaatcagatcagggtaattagcatatccattatctccaatatttatcatttatttgtgttgaaaacatttagtatcttctagctatttaaaaatagatattattgttaaccattgtcattctacagtgctataaaatattagaacttgatcattctatctagctgtaattttgtgttccttaacaaatatctcggccgggcgcggtggctcacgcttgtaatcccagtactctgggaggccgaggcgggcggatcacgaggtcaggagatcgagaccacgaggaaaccccgtctctactaaaaatacaaaaaattagctgggcgtggtggcgggcgcctgtagtcccagctactcggagaggctgaggcaggagaatggcgtgaacccgggaggcggagcttgcagtgagccgagatagcgccactgcactccagcctgggcgacagagcaagactccgtctcaaacaacaacaaacacataaaaaaaacaaatatctccacatccttcctttccctctaacctttccagcctgtagtaacctgttttgcattttacttctatgagatcaacttattttagcttctgcatatgagtaagaccatgcagtgtttaacttttggttcttatttcacttaacataatttcctccagttccatccatgttgctgcaaatgacagaacttcattttttatgtctgaatagtatttcatgtgtatatgtgtcatattttctttattcagtcatccactgatagacatttaggttgattccataccatgacaatcacgaatagtgctgcaataaacattggggtacagatttctcttcgatgtactgattaattttcctttggataaatggtcaatagtgagattactggtatgatcattttaatttaaggaggtattcatcaaactggttgataaaattaactagtcccagcttaagatatctgggatctagaagcactgtttatatactttgcatgagacacagttctaaccatacaattaaaaaaaaaaaagattccaagcagttcatacctgtagcctcagacttaagcttaccctctaattagttaaacattagggcaatgattttctgcctgtattttataaaatgtcttcatgctggtggtagagtgaatgtggaggaaaagaacatatttaagtggaggccattcatgatataagataccatggaaagcttgagttttcagtttaggctacagaaaatgcaaataaataaattaaacagttggtttaaaatattactacaagtaggattttcccctgaaggaaggcttggttttgtcatgttttatgctcggtttgttaggttttattgttggcttcatatgtctcttgctgatgggagtatgtgacgtcaccacacggcatagagaggaccaagaagctgtcccagtatcataacagaaggagactggaggcaatgtgagaaataaaaatgcagagttaagaggaggtttatacaaagaaagaactagggagtgcgaagaagagacataatttaaaagaaatgttttcttttattatggaaaaatatgctgtttatagtataatgtgaatcctcttctcattatttttactcaaacttcattaaaatatcaatttctggttgatgcgttgtgctttttaagagataccacgaaagaggacttaggtggttattctggaatatgggtatttacgatgagtaaggtgactattttcatgcaatcatttcagaatcagcactgtgagctgtcctgccttaagacaatcgttgcgcacatctatacaatactatctatttcactccaccaccataccaatcatcgagcgctggctgctcagcagggtgcggatgtgtacttgaccatagccatagtggttctcttgagatgcagacagtttctacactaaaaatgagttgacgtttaggagaaagaaagaacaatcttggtggtatccatttgaaaaagggaagcggaacttcaaggaaatattggcacaaaaactaagactgcttacaagaggattacctcatctgggttagaggaggatttcaaggatatgaggcgctctcatcacaataaagcagacattcccaacagtcacagaagcaggcaaatgaaagatgatgtaaacttatataagacttgagttgcttcatcttaagcatccatccaatttcagtacatgggttcttttgctgtttcaaagttctttttttttcttttagtactgtacatttccatataaactttcattcagagtttttacttttaaataatttctgtagctgccttttgtacttatttgaagaataattgaaaagaaaaaaattgagaaaattaaaacagatttctttttgccaaaagaaagtattggtaatttatagcaaagctggaaacgagggcctcttaagagttttccaaagtatgtcagctagtagcatggggttttagatcttttctttactgcaatcaatcctgctggaaatatgaagtcagttcagaagatcagtagagttgagctagcaaaagaataaaaatcctgaaaggagttattaattatgtgcatactgtgtgcagacagaatcagaagatactggccaagacattatgaaacaaggaagaattcacgagaaactttgaaattgccatatgcaagatgcaagttccctttacccaattttgcactcatcttctgatgctagaaaagcaaatgagaatgttgctaacacaaatgttatgtatttgcactgatcgagatgggtgagttcaacaagggaatccagtctcagtgtggattactgataaatgtccttgcttttgtgctagcctaaatttctagtgttgagagacacattttgtgtagattccctatttatattacattaactaagtatcttgaggatatgatgatttcagtaaatgtcattcacacaatccatcaatagtcccggggtggaggggcgttatcagctattgtttctctgaataagtattatcaaacattgcttttctgctatacagaagcactatggaatgaaaccacaaagtctgtagacaatgtttttgcacactgtaaaaattttataaagtcaggtttcatttaatttacacttttgtttctggttagtgtttttactataatttgggaataatgtacagtggtaaatcattgtgaagtaacactgcattctccttaaaattgggatgtattcaggcatattaattatttcaggattcattaaatataattctaaaagagtttctctttaaatatttatctactcttgactggtcgtattgaatctcacattcattactaaaataaatttaagaggccttgataattgcagaccaaatatatagttacaattgtcgctatttataaagaggttcaagaactctaacctataattcacattaagttgaggcatcaaagaaaaaaatacacaaaaaaggcatgttggcagtgatggtggtactaccaaaggtagagttgggtttcattcctttcctgttccagcctatctattgcttttaaataacttatgctgctcgtgtgtgaagggatttctccttttactcacatatttacaacctctaattcaggagagagattagagatagagaatctaatacccttttaagttgcaggactataaaaacaaaataggcctcactccacttttctaaggcaagattctaggaaaggataaatatattcatgagtcaaaatccactacaatgaaataagtaaccaagggtaaatatattcatgagtcaaaatccactacaatgaagtaagtaacctaggttactgaccagaactctgcattgaggataaagccaaattctttataacctcaactctgtcagagttggtagtaatcaggactaggattcagtaataagcacttttatttaatatatatatttatctgtctctctctctctatatatatatgtatatatatatatatacacacacatatgtgtatatatatatacactcatatatgtgtgtatatatatacacacatatatatgtatatatatacacacatatatgtgtgtatatatatatacacacacatatatatagcatttcttcccctttctgttcaatacagcacactgattctttcctactatgtgatgctccgggctggtatgtaaatcaagaggcctgccttccctagccaaaatgtgaacacagcagagagttagcagggtgtaaatgaatcctactgtcattcccaataatttgaactgtgagtacaatgacacaagaatgagaaaaataaatggacttcattcattcaattggtggtgctctatcaacattgtcgatttgtgcttcctacatagacccctgaggctttactgcagcatttttataaactagtctcattctcaaaccttctcaacatttgtgtgggctaatattctccagaaaagatccttttatgattaaattggccactattggtttatgttcatgcaactacagaatcataatttatagcacatggcaagcatataagaaatatttgcacttattcttataaacagcagtggtaaattctacattgtttagccctttggggtggtttgcttgaattctatatagaattacaaaatgttccgcagagaagttctcaaataattcttgctgtcattcatgtaagataagtaagacactacttcgtgtgaggtgccacacataagttctagggaatacttcatcacttttgagcaagccagcaagaaagcccttaccacaaggaggatatattttaagagaaagagaaatgtgagtcaatcagttttgatagcttatatgcaatggacagttatcagtctgagcttacattacatttactaacgtaaatacaaaaatctttgggacatggtgagagatgtcagcattagctagctgtgggtcagctgtttactgcaaaacctgcaaggcttgggaactgggagaactgtttgttctcaagaggagacgtgaaacccgaaatatctcccttgaggatgggattttttaatgtacaattctttatatttttcactaaaatctatgtaattttctttcacaatcaacataatctgacaaaaatgagctgttcctcataatattgagacattcttggaaacattttgaggaaggaaagcttaggaaaacactatcaagtttctggccaaagagtagggctccacacatcaggatttgaggtatgaataaaaatgaggcatttttacactcatcaggtgataaagcaattgtgtaaaaaaaaaaaaaaaaaagaaaattctagaatataaattatcttttaacgaatgagaacaaattactttggagatatttggtagcttccttaatcatagtagctttgaatgatatagatgcccgattgtcaacagagatcaaaactaaatcagaaacttaaaatggcccaataaaatgtaaagctccttagaaaaacagcattgctataaagtctcaaatacagtaatgtgggagaaaatgacacgcacagcctatggtaagggataagagctgcaatatggagaagtttatcttggattctattttattacctctacctaagccactttttaataaaaatcatcaacagttcacaccataaaacattttggacctagcccaagtgagaaaagtcaaatatatttatatatgttttttggctttttaagagattatttattttttattatactttaagttctggggtacatatgcaggacgtgcaggtttgttacataggtatacacttgctatggtggtttgctgcacccatcaacccatcatctacattaggtatttctcctaatgttatccctcccctagcccaccatcccccgacaggccctaagtcaaatatattttatatgagatccatagtactcacaaaatttaatacatctatgtagacattgtcaaatataggaagacacttaacatatttctttgaatatactgaccctttttatatattaatgcctgtgtatcaaagtacatttcatacacagtttatcttctcctgaaatgtgattataaaattgatactctacaactgatgaaaagctagtaattgaaatgaagtcattctaatgaagcaataacactaacatagttttccaataaatatactgtgaatgacttagcctatggaaaaaggttttgaataaaaattattattttctaaatatctgaactgtaagatattagttctctaaatctatcttttttcttttccctggatttgaatatcatagctcactaaacatctttacaatttgcttcctctaaacacattctttcttctggaaataaaatggtgctttgaaagaatattaccaataggaagacatatttcaaacacgaggttcctgctttcaattacctaacagctggtactatgcgtttacatttagaaagacaaaaccttacaaagatgtattatgctttttcaagtaatttagatttgtcacagtgcaagaaaaactcattggcaaataattcaaataggcttgtaagtctcagagataaggggctttaaaaaaagcaaaatacattctttaataagcaaagttatgagacagatctataaaatagaattgagaaatctttcaaagtattccatgcagaacagctgatttagtaacctactgtgaaaagaactattgatactccaatagcagcggtgatacagtgaaaaggtaaattttgaggatgcgatatgactgcttgatctagtagtacaatactgtgaacaagcagggactttgcagctagacgtatttaagttccagttctgactccataatttacactgctgtggttcacttaaaactctgtgagcctcagtttctatatctttaaaattaggctaataatgcctatgtaagtgttgtgaaatgctcagaaatataaactaaaatcaatgctattgttttcctgtcatctggcaaagagtattgctccaattttatgtgtcaagtaatgtaaaacgtaaaagtactaacctaccaaatctgttctttttctaattgattacagaagaatccattaactttagtggcaagaatgtctgttatctctcaattgttctctcccttcaggctgatttttttgctaatatctttggtgctgagataatccaaaagagaacccccatctcctttagtggcagagctggcacaagcttatacacgacctcagggacctaagaactagcccaccaagcttgctaccactggagtccccaacacatccagtggtagtactgccacacacaggagagctggccagcccaatatctttctctccagcaaggcctcaccacagtctctacaaacaactgtagtctatgctaccaagacactcacccataccactgatgttaattgaagtcagagaaatcacatggagactatactaatgtgcccaccagaacccaagccaaagcactctaccaaaccaacactctaggacacatctacaggaaaaaaagtcttttcctataaaagctactccataaaattggaagaagaaactattccaccagttgcacagatatcaatggagggatacaaaacaggtaaatgcaaggaaacgtgacactttcaaaggaacaaaataattttccagtaagagaacccatctctaaaaggaaatctatggaatgcttgaaaaagaataataataattaacaaagaaacagatacaagaaaacacagaaaaaatgtttaaataataagaaaaataatttatgatctgaatgagaaattcaacaaaaagataggtatcatgagaaaaaatcgagcagaaactctggaactggaaaattcagtgactgaaatgataaatactactgagggctttaaccataaagtaggaattttttacttgaagacatcttttgaaataacctcatcaaataaggagaaagaaacaaggaaagaaagaatgatgaaaaggaaaaaagaaagcaaagtaaacatagtaaagaaagcctgtgagacatatggaacatcattcagcaaataaatatttgcattatgaagtttctgatgaagataagaattcatagaaaacgtgcttaataaagtaagagctgaaaaattcccaagtcttcagagagatatggacttccagagtcagaaagattaaagatttcctagtagattcaacccagagggttttcttatcgatacttatagtaaaactatcaaaagtaaaagacaaagagaattatggatactggagtctccaaagtggggaggctgggaggggaataagagagacaaaaagccacatattgggtacaatcttcaccactcaagtgatgggtgcactataatctcagactttaccaattgtattaatctgttttcataatgctataaagaactgcccaagactgggcaatttacaaagaagagttttaattgactcagagttcagcctggctagggaggcatcaggaaacttacaatcatggcagaaggcaaaggggaaacaaggcacctttttcacacggcggcaggaaggagaagtgtcaagtgaagggagaagaacttattacaccatgaggtcctatgggaactcactcactatcatgagaacagcatgcaagaaattgcccccaggatttaattagctccacctagcctcttccttgatacatgagggttatagggattatgagggttacagttcaagattagatttggttgaggacacacggcctaaccatatctccactatacaatttatccatgtaatcaaagaccacttgtacacctaaagctactgaaattttaaaaaataaaaaaataaataaaaagatcttagaataataataataaaaaaaaaaaagcaagagaaaagtgttgtcacatgtaggggaatttttaccagactaagagcagatttcgcggtagaaatgtaacaagccaggaataatgggataatagattcaaagtgctgaaagaaaaaaataaaagttggtcaaaaatactatgtccagcaaagctactgtttagccatgaagaagaagtaaagtctttcctatatggacaaaaactaagagaatcaattcatcaccactagattggcctgaaaataaatgcttaagggagtccaacatctggaagcaaacagatgatatctaacatcatgaaatcatgcaaaagtagaattactgatggagaaaaatgtaatccaaggaaaattgtggtgctatgatcagaaggcaaaaataaatactgggaaaaaggcaatatatatttgtataactctgcataatcatataatatattactgctttttgttttgtttatatctttatacatgctggttttggtcttgaataatctgaagatgaatctatgtgaatgaattaatttttatatattttattttttctacctctgacttcacccagctcccaacccccatcgcatactgaacccattaatggcttcatttccatcatgtcagtcatcagtccttctctaagccccaagacatccctgaccaagacaggaagtgtgcctgcatttcagaacggaacacagagttcatctacccgatatgacccaaatatcagatcagaagaagatacagagcaggcaaaacacaaaaaggaaaggcagcataaagtcagttccattttataaaaatgcctttcttttttactcttcttggaaaataacttcttgttctcaaacttttggtgatcagaaaaaaaaaataactttatttttttctttctgatacataggagcctggagcctgcctcaacatttttttctcttattgttctacctagctgcatacctcagtattaatactagaataaaatgtattttgcttttctttcacaatcccctcctcctttcttaagcttcatattttagctctctaattaactcccaagtagggtaatacctaataagcattatgtatacaattcctgagagactatttaagaaacaacccatagagttatcccttgcatacctttgatgagtttcctggatccccttttgatctggattaattaatgttcctgagggagtgctgattttctagcattcttccacctttgatgcagaatctcaaaattcccttgtacaataactttgggtagcaacatgaacgcaaatggctgttcagatttcaagaccttctatactaattctttgtaaacttaggctgagacaagggggaaaaaagcatgtagcaccctggataaatcttaaattctgccatcagagctaagatttaccgtcatctgtttctgcagagacagacatttttttttaaaaggcatcctatgcttgactctaaatcctcacttatatcttcatcaccatctagagatggagcacctcagggaagttccagggattgccatcagcacccccttctctctgatacgttgttaaaggtttcctttctaataaataatttattgagttcctagagctatagactgaagtgtttattttggattctacattttttcattcaataaatgtattgagtgtccacacttatgatataatatgcacttatacttctccaggtaaagtaatataagaaattgtactgattggtgcaattactgaaagtgaaagtcccataatcaccgtcagttataattctgtgcttttagaatatatgacacaaaaccggcagcttgatgagagcatagcagtcatgcattcatctgtatatcaatgctaggataatatcatctgaggagtccatagttaaagtctcgaatgtagcttttgaatgaatcatatatgacatacataatcagcaagaacagacacatgattctactacttcactctattccaccagttaaagtttgagctcctaggagaagatctttcatatacaagacttttccaaaataacagataaaaacatagacacaatagtcccaaaaatattttcagagaattcaggcaagttatttttcaagtatccatgataatgctctgtttatagaagtcaaagacataaagtacagattattcacaagaaacagctgtcttgagaaacaaatctgatttattcatttaataaacatttgttggcaccatgcaggtcagtactgttgggaatatagtcataagaaagatacgtttttattaaagcagaattttaaatgaagggtatgctttgtggaataggattttatagatctttgaatttatgtcaatacaatgaaatgacaaaccgtagtttcttatcatttagtcttcaatatatgactttaggttttcttcttatcaatctgttcctgttactaagaaaacaatttatagtattttataataatgagaataaaatcaaatagggtatggcaggtcttcatattattattacaattgttcttttataacttgtatccattgcaattttctttgctaatttcctcaaaagttaactatgtaaagatattatatttctatataatatctctagatttgtttgttctaggttttacttgtctaacctagaagattatcctacaaagtccatggcctttaattatctaactttgaaggtatcatctttagatagaatgccaattttgattctaaaaaacttgatcttgctgtacatgtgaatcacataatgcagttaattggttcattaattatctataaaaatgtggaaaaagtcctaaatggttgacaaatatatgctaaaagcagggtataaatataggccaacatttaaaaggtttccaaaatattctacataaagataaaaaggaaaaaaaaacaatttttacaaaaatcatcttaatgtatgctttgtgacagttacacaaatatataaagtgtatgatacaatcctttatctaaaagcatttatttttcaagttttgaacttgactttttagaaaatatgtctaagtttttacatatcattatgtgatagtcaacaatagtgtcaaaattctaaacaatttgattcaatgtgagaggctactgcaatgtttctcacttcagttactcttaagtattctcttctgcaaggcaagttacactacctctatattatctaaaagtgactcttctccaggcatcaagagtgcagaacatgacaggatgagccagtatggacttttcaccttcccttcatggggcagaaaaacattcaggaaatcagagattttcagtttaatcatcagggcatgaacctcagggctcaaagctgctgagagccaacatacggattttgaggacagattcaactagcaaagccaatggagagatgcatcccaaattcatgtttgagccttaagttcagcgaagcttgtagcaagccagttatatatcactaggttttcaattagttagaacaataaatttatttatcttctcttttgaataaacttatttaggcagaaagagagtatccgagagagcgtgaataaacagcatgagaaaacttggaatatcttagcaacgcaatgacaccataagactggcagcactgtagagaaaacagagtaagaaagaagagaggcacaggaaggggagaaacaaaaaataggaagggtgaccatcaggtgaaaaataatgagaactttcaggaacatatgggaggaaggtttgactctaaagctattaaggggatagaattaacaggaaaaaatatagcatttgaaatacgagcagaaacaaacagggataaaacagggctgatatatgggtttcaagcttgtaatatgatattagatgttattagtagacgaaataagattataatgaagaaaaattagaggttaggaagcagggatggagaagagatcatgaacttagttttacaccttatgaatctgaaataatcatgggatatccaaatgaaagttccaagagacagttggttatgcaggtctgagctatggaataaaatttggagatgtcagagatacaattttagctgccatctatagacagaaattagttaagaatttaacggtagataaaataaatcagaagtaatatggaaggctggaggggaaaaaaataagaaagtatatctgagaacattaacgtgtgagatatacatagagtaagaagagcttgaaagtaaacctaaaatctgtcttcagtaataagatttaaaatgtaaataattataaacaaaaaataaacaaaaggtgaaagttatgctatgtaaaagtaggcagaggagagattctaagatgggggaaaagtcagcaatagcaagtaatgcagatgggtcaaatcttccattgagtttagcaagtcattggtgacaactggtatggggcatctcagaaaaatagtaaaggtggaagtaagattgcagtagagaaagtggaattgcattaataattcactcaatgggtcatcgagtttgaagttgaattcaaacttatgaatctaattctttatagaatcaaggtcctctagaaacttggtcatttcctatatgaaactttcaaagaagatatttatattccccatgagaataatactaactacatggaatatggggtcacattgaatgtctcaggaattgttgctgattttttttctatgagaaagcataagtacgtctaatatagtgaatggctcccaaaacattcatatttaaaattcatttgacaaccaatatataacataacatttataagaatgtctttggtatgaccaacaccaaagcaaatacaaaaacaaaaatccttaaagacatactatgtgtgaatgttataagttatccaaaaatcttgtttctattttgtcccttgttaaatttttaccctatgacttgctgagaagctgcaggagagagaatttcctgatgagttgtctaacagcttattctttcctcctgctatgtcctcaacatctatgttcaatattaaattgcactgcagcggagatgactgtgtgtgtgtgtatgtgtgtgtgtgctttaagcaaaagacagaggcttgagtgatttagtagctacaaatataaatcactgacaagcaattaacatatactttggttcaaaaccaaatatttccttagcaacaatcataatcactattttacagtgaaaattggcatatttatgatatgttgacattaagatattcagtaagcatattgatgtttaaattccatgtttaaatgcaactatttataaatcaatcatcccacaatcaccttttcttaattttgaagtgcaaatatgtgagtttaagattttagattgaccaaagtgcttatttgttttcttccacatagctcagtttaaaatttgtaaaaagtattaaaccacaggaaagaaaagtgataaaagcaaatatgtgattcagcaagtttcttaatgtttgaaagtaaatggaaggtcataattatttaaagcagaatacaaaaatatcacattgaaaatggcaaaattgggtgagtatggataacatacactatcaaattgactggagaaaatacgacaaacttaacaaataagggtagcatgaaaatcaagaaagattagtggtgtcagttaaaatattaaataaaagtataggtaaattagggggatccttccccaagttctgagcaattttcccataagacttctccttccccataactaagattttattttctgaagaaattgtcagagagccaccagacttttaagtcaaagaaagtaaggccaattctttgcttgagtacaggaatgtctacctgctgacaagctctgctcatacacagaagatttccaaagagcatctcagtgcccagccactagtgacagtgacaactatctattaaaaatccacacacacatttttacatatgtatatatttacatatatatatatacctatatatgtaaaaaatatatatatgtatttccctcatcttttagaacacaacaagagtatttatctcaacttcccaatagttaaacttggccttgtgactgagttctagacaaaggcaggtgagaagtcccatgtgccacatcccatcctatcttgatttatgaaaccttctttgcaggctgcttatttttttcccgcagaaagttgtctggggtaacaaatcctctgagcgagcttggaagccatgtgttgcagatcattcccctggccccaaggtcctgttgacttaaaatccacccacacagagatacatgaaaaataataaacactgaacaattacacgtgaagatatatatgtttccattgcctacatactcatctaataatttaatgtgaatggagaagcaggattaatcagcctctttgaataaaacctgaaaccctaaaaatggaaaataaaacagaataaaaaataaaaggtgggaatagggagaggaaataatagagaggtagctaaataaaactgctttaaaataaacatcctcacaaagataagaaaatataattttaaaaaagcaaatgacttagaggataagaatgagatcttgagagaaaaatattaagacccacaaacaaaaataacaataacaacaaaaatactcaaaatactcctagaccaattatctttcaatcctaacacagcacctgaactgcttttcatgtttactaataacctccatttttgaaaccagtaattatttatcagttcctgtctttttggaatcattaatggtatttgaaacaattgatccttataagggcccagagctcttcttttcttaaaataaaagaaatatgaggtagtactcagcaatcaagtagtccagataggtcaaatcttccattgaatttagcaagtcattggtgacaacaggtatggggcatctcagaaaaatagcaaaggtggaagcaagattgcagtagagagagtggaattgcattaataattcactcaatgggtcactgagtttgaagttgaattcaaactggagaatctaatcctttatagaatcacagtcccttagaaaccttgacctcttcttttcttaaaatttaaggtccacagaccttttcttttcttaaaatttatatccagcccaacttctcttctaagctctaaacttgcagggttatctaatttgtatgcattatactcatctcaaacgtaacatgtttaaaaatgagatcttaatttgcctttctaagctcatgctaatcttcccatctcagtgacaattttaaaaatcctgaagtcatccaatctctctctctacttcatatctcacatttaagccatcaatacattatggtgattctatctttaaaatgtattcagaatcaaaaccacttctgaccaccgcactgctaataccttaggctgagccaccatttctttgtgcctaaattattgcttgggctccttaatttctcatttctgctctcatctacctgttgactatttccacagagcagggagagtagcacctttacaatgtgcattaggaagacttctgatttcattaagaagcccctcttgttacaacacaaaagccctgtacacaacacaattaatgagcatagaatgaccctgagaagtagaaagaacaaggtgaactggctagagacctaagggccaacaacaacatggcagtgagccctctgggtttccttattctggcccataatctggggcagggctccaaaatggactggaatatagatgcaggtccaaaaagctccaagaaaaatatctttactctaaacaaaggaccagaaaaatggtggtctaaaaacagaaaaagttttgggaaatacttgcctactccagccaaataccaaggacaaaaattgcaccatctctaccccactagtgacttcagcaatgtcaagtagggagcagatttttcacaaatgacaaccttgcttctgagaaagcaggtagctgccactaaattcatctactcaaggagctgtgatgaatggttttgtgtgtcaacttgactgggcgataagatacccgaatacttggttaaacattattctgggtgtgcctgtaaaggtgtttctgaatgacattaacatttgaattggtaaactgagtaaagcagactgacaacccaagtgtggatgcgctttatctaaaccactgaagtcccgaacagaacaaaagttgctctccctacctgtcttcaagctgggacgtgagtcctttaccatcagacttgaactcagactggatcaataccatcagtattcctggatctccagcttgctgactgcagatctagggacttctcattctctgtgattacttgggacaatttcttgtctatctatctacagatagacagacaaataggtaacctatttgtcacctatctaatttcctattcattctgtatctccagagaaccctgacaaatacagtaatatagccaggttgagcactggcagggtgggatcttatatctcattcactaccagaaagaaggaaatgtactgagtcccccattcccaactcctacccatatcatgctgttagcagagtcctccacctggaccaccaggtgagctaggtgagcctctattcctacccagtaccaagctgacttaattaaggaggcaatatgaggatgatcttgtcaattgtaggctccactccactactccatgtcaccaccagcacccaatatcagtaggctcaggggaactgaaccttcatccccacctgggcatcaatgagattgaaactgtgttgcaagtctaggctagttagcactgcgctttatccccacccttggtgtcagggatattgagtagctgagcctccacacccattctgcagcaaaaaagtattgcaagtcaattctctattttcaatatctctggtggctctgggatacaggagggaagctgagattttatacacccacccagaggcaatgaggcagtataagtctgggtcttaaaactgctgaaaggaggactgccattctgaaaaatcatggaatttagtggccagcatttttgaagacttagaaaaatttatttttctaagtcaatttatctattgactatcatgatctgtggaatgtctcaaaaaaatttaaagatacaggttcagcaaagtaagctgaaaaaggcatgaattaatgatagaaaaataaaaaattagaaaagaatcacaatctatttttgcatattgtagtaaagtagccataatttatatatgtatatatatgcttatatatacatatatacacacatatatatacatatataaacatatatatacatatatatacacttgtgtatatatatgtaaaactgtgcttagaacttggggtaggataaaaaatgagctgatggtataaaataaccaaatgttaaatagcgtaataggaagaaaacaatatcttgaatcagtaaatcaaaagataacatcataatcatgttatttaaaaatatgtgaataaataaaataagaaacatcacaaaaaagggtttacaaagttgtataggaaaacttgactaaggggcaggaatgtgttcttttttttttcattatactcacaatttaatgttcttttttgaaaacaatgcacagctatttctttgattaaaataatcatgaattctaagaaactgctttgagatatatatatatttcctttaagatatatatttctttcctttaagatatatataagatatatatatatcttatatatatcttaaaggaaatataatctacatcaaaatggcaactatttactaaacatgcattttattacataaacacacagcaatgctctttgctttggcattttctcaattacacaatatcttccattcaagttaccatctcctaaaaagttatttgagaaaatcttatttctcacaatgaaaccttattatctgaagctcagctgaatattgttctatccttagccctaatttacaaatacaaaataataattaatataatgtatgctattgaaagctcagtatatcctgagtggaaatttttcaataaaccttataaatatgcctgaaatgtttgctgtcatttttttgaaaaatattagcacaccaatgcaactatagctaatgttccaaatggagtattttatttcatgcttaccgtatcagatggaatgtaaggttaacagactttcaacacctcttaaatgaagggcttcatgcacacacattcagaagtaaaattaatcagaggggcaaaatctgtacctacctggtagaggttaaatggatggcatatttaaaatcaccattcatagctcctggcacacagtagactctaaatattttttccttctatcatttataagataaattcaacaacacatcaaagaaagtaggaaaataaacattcaaaccaaactcttgcattcattcctagattgctttttttaaaacatagtcaaacagtagtaataacaaatttagtaaaaagttctgaattgtaaaattcaaaaattgtttaagttcaaatttttaacataaaattgaaaatcaaaatttgagtactttactttctggcaaatctctttatttatcataatctgccttatagctagggatagccttagtactttcatattatacattttcacttacaaaccatacacattctttatgatgatatttctcccatcttttcttgaaattcagaaaaagaagtatatgtgtgtctcatttaaaattctccacacttcttagttttatactttttttctaacttaatggtccacttttccttgtccttggtcgatcttcactcatcttactataaacattcacttactttttaaaaattcctaccgcctctctcttccaaaaccagtccttatattaagtaattaaataaaaatgaccaagtcaccaccaggacaaaataaatgtccattctcaaaactattacttcagttggccttaagaaagtaggatggacagtagggagatatcttttctagtaattctgcaaatcaataccaccattctctgcaaagcagacaggaggaaattgattgtttcattgcaatgtttcatattaaaaaaccaaaacatcatttcagcttttccatactctatggaaactaatattcagagcaaatatgtattctttcatcaaatatttattgagtacttaccaaattttggacactgagctagttagtggaattactaaaatacaacgtgcaaggccacaaatgaaatatgctttttcatttaattgagagcaagactatgagatagaaaataatacctgagttttccaggtgatgcaactatagcttatcaatattaaattactcactatattctgtgcagaataagggttgaaacaaggatttaacttgacctctgatgccttgacctctgatgacaatgcttttgctttcaagaattatacctaaataattatgttgatgtcaaggatgatgatgatgataagtatcaatctccatttactgaaatataccttggtttcaggtcctgtgcttgcatgctttatgtatgtgaattacatccttttatcaccctttacagagagaaaccaaggctcagagaagttaaacaacttgatccttgctggtaagggagtggaatagaattaaagctcaattccatctggttctgtattcttttctttaccatcaattctctatagcaacagttattgaaacttgaagacccatctcacagcctctctcttacatacacacatttaatttcattctccatgcttggatcacaggctctcttctctgtctttctacattatctatctatctatctatctatctatctatctatctatctatctatctatgtatctatgtatctatctatctatctatctatctatctatctatctatcatcatcatctaggtatctatatctatatatcaaccttcctattatctgtatgtatgcctgtctcagtctccctttctgtctctatctctcagactttctgtctctatatccctttccctatctctttacatttttttgtttcattttgattattatttgtctttctggcaatctgtctatttctgtctttcttgaccctgtgttttcccggcctgtctgtcactctgcttctacctttctgtctcaacctatctccacttctctctctttctgttcttttctaagtgtatatctcagtttctctttctgttccctttctctttttcttatatttgactgtctctaacttttattatgtttttccctgtgagtctctctcattttctttgtgtgactatccctgtatctctctttgagtttgtatctctgtgaatatctttctgtgacttatctgtgtctgtctctgtctctcggacagagatgtaagattctaaagtaataaaaacctctcatccagttttaatgacccttttctggattccagtgatgtgctgcaaagttgaagaaataagtcccttaaatgataaagcaaaaagaaaagtcactgtccttggataaacaatttgcatttccataaggattcagtgatgcagaatcagaaaaggctcattctgacacctccatgaaaacaacagggagagcattcattagctgggcttccttttgaatgatgcacttcattgcacacaccgctgtcctcccccggtcaggaaacagtgcttaattctatcggaagtttgccctttcactaggcatgagaatgaatgacttttcaaagtaataggaactacacatctgccatggcctgagaatgcttacactctaaaagccatacagaaagttacacctcctatcaatttcttatccatcaaggaacacaataaacaagctttgaacttttccatttaccaacttgaaggaaagaaatgcttcattttctttagttttttgaaataatgactgcttttgcctcttacatttatagcttcaatagccatgatctaattttaagggtgaatgcaacctttaaacaaggtttatgatataaaaggaaatttgtccattacagtgctcagaaacttttactctttaggtgaaaattattttgttgctgttattgttgaaacacacacacacacacacacacacacacacacacacacacacacgatcatcttaggaagtaattggacaagattaaaacaattaattgtatttaaaattatttagcaatttacaggtttcttattcattttgctggcttcatttataagttatgtattttaaatgtggacactgaggaacaaatgtttagagggtgtgctgaggttctcaaggaaaataattgttgtccttcggacagaatatgatgtttctatgctccttatattaataaatagcacacatgtgtatgtgtgggcagggggggagcggggtgtgtccatcttactcagcgtgactgacttttaggctgagattaagtcatactcgtctacatattcttccaagtctctcacttcagtttatacaccacagttgaaaattgtattttaaggtcaagctagtcgctctcacattcaaaactacctcccatcctgcccctgccatccatacatgcaacgaattaacatgtgcatttggaatttctgggtgtattctcggttcttgtcaccatttcaacctaagtgcttccagtattcaatttaaataaacgttacagtttctgggtgatttacacctctggaatttctatggcgactctatcaagagaaaataatctggccataaattactcacattagctttttttttttcctcactcaaaattgactatgagcactaatgagtcaccacacttccttccaatacccttggatgcaactcagtcatatttgagtctgaaactaataaatgaagccccacaggtcactgttagttttgaatccacattctctcatgctatagtgttaacgacaacaacaaaatcccattacaaaagaaaatatatcaaacctcaaacaaagttttagttgagagtaacaaaaatagtttttggatgccatccctgacaagtaaaacaatcttttcaatattataattgtatagtcttattttgcatgtgaaaaccacagatacatagaatgacaaaatgattctagttcacaagtggtcccgatactaagaactcttttaaaaaatggaaaaatacaaacaaaatgactatgaccaaaacccactcttaaaatagagtctgaagtaaaattaaacttttagataataaatatgatcattttatgaagtagtgtggtctctttgtttagattattatttctgctaacttttccttgtgttcaaatcctgagtgaaacttaaaaccatgtatttctcccagcattagggctacaataaaatgtaaatgtatatggggggcttctgtgttaggaagaagttaatataacagctcgtttatgaaaagctattgttttacaccatttaagtaggaaaaaaagttcctacagtctgaaattgtatctgcacatttacagaaagggggagtacactcatctacccaataaagtagtcacatttatgaaattactttataatttttggttttacattttactattttgagaaggttcataatttgtctaaggagtaaaagtcctcatgataaagtgataacacaaaggaatcattaattcctcaacatgtatttgcttgacgtacgttttgtgatcaaataattatagtgatttcctttgataaaaataataattaccttttgcctttaatttcaaacataagctatgaaccaaatactggagaatttttgcaagtggcataaaaacaatttatgtctgcctatctgctgtgaaagttgtataataaaaagatacaacacataccatgcaaaatttaaatgtgaacaaattaagagcaaagttgtaatggacatttatttttcactgggtttttttaaagcataattattagtgttttttaaaactatagttcagatacttatcaaatattatcagtgggtataccatatttttaaacatttcctagaaaatgaaatgttttatttaaatctttttgtgaataatattcaaaacttcatgccataattttccagagaagttgctgacacttaggtagcacaaactctgacctgttcaggtcacttaatgattatgtttaagggtaatttggggggcaaagttgtagggattcacatttcctgctcagcacataattgcaacagctgaggggttaggaggtcgccactcagtggaattgggcacccattaaatggcacttttatttcataggagaatgagtccacagtcaaggggatcaagttgctgaaacttgaagacacacatgtacagatacattcactcattcacacttagccacaacttaagcaaactaaagaaactaatagtaaaaccaattttctgtgaaaagaaaacaaaaaaacagttcacatgagcatatacaacaaagcttcatacctgctgtgcaaaccacagcaagcattttgcgctcaaaatatgcctcttttacagattatttgtttctctaatgttaagcaacataataacttaagtatttggttactagatttgacaattggctcttttgtgaaagcaaatgagtatgacttggagttaaccttacaggaggccatcatattatactctagttaacaatggctttctgcatacgtgctacaagtccatcaaatcgatggccatctgtgtgtactagagacacagagtatcaacacactgaacctgaaacttgttattcagggcccacccactctatagctaccaaagtatattttttaaagtaaaggccacatcacaaagtgggaaagctgttaatactatctagcattaattctgtattagaaggatacagttgacctagattcaaattctaaatggttaatgcttccagatacgcacaaaggaagtaaatattctaataaactaaaacatccacagtaaaaatatcagtatactcacaaaagacaaaaaatactgttcattgtgaggcagaattagctactttaactcaactgccaactataacctccagcaacaaccactcataaaacaaatcatcaatatttgcacacagaaaaacaaaaagtcaattctgatgccatttttctgtattttttcaggttggaggaagtagaagaagtggttgaggactaaaaattcttttaaataacaaaccagagttataattcaaaagcttgtgtctttgtaaagattacattgtcatctaaacaaaattacaataccagacagtaatcaggaagaatgaaaggacaggcagttgtgttcactcttccagcaaataatcacttgcaatcattactactctattctttcaacaagcatgacagaaagtagcatcatgacagagatcattgtactgaaagaacatcttaactttctctgtggttcactgctgccttaaatttgaaaaaaataagagaagggcgggggaagaacttacttgcggtttaaagtttcatctttagtccatgtaagattatgcagcaagttttcttgccaaggctgcctcttgcacatccctttaaaaagaaccagtgctcataatctagttccaagacgattcattcacatgttccacctcttgtttctgtgaggcattgatatccactctcatatcatcaagaaaatgttactaggaaaatttttagaaaagcaaaacagttcaacatgttaactcagaaagcataccatcattctccacgttctgagatgtatgccacctgccttagttaccacaagcaactaacactaagctgctagcaggaatctgtctgccctctatctgtcgctattagctcagcacgttgatttcactggcactgaagcaacagcaattagctatcttgcttctcgcagcacatacaggagacagctgagtgcgctaaaccacgcactgactggtgagcgctttgcaccaattagtagcaggtgctacagcccaaaagacaaattgatgtccactgatcatcggtactggctgctttattgtactgtgttcgtcagcctgtctgatgattctctgttctgttttgtgtgtttgtttttactgttttactttatctaagaagtttagcagcttacattcaataacaatgtcgttgacaagataaaataatctcttaagcttcttttatcattctctctgtctctccctctctctctcattaaatctaccctcttatatgaagccctccacatctttggggcataaaaacaaaacaaaacaaaacaaaaaaacaatttcacaacttcacacattctgtaggagccaaaagtactctttagatttttacaaacacgtgtgactggtagtatataaggttatcacgaagaaatatactatacaaaacattatagcatatttcttaaacattgtaatatatgaaatctccaaaacaaagttttacagatggacaggtaaactagtaaaatacaattatgtcatataaatcagagaaacatttcttaaggaatctatcttgcatagtacatatttcaattccatattaaatttcacccatgtgttcacctgagcatatgagaaggaaggatctagaaacaagcaatttaggaacatattttagtagtgattgtgacagagcagataggctgaggctggttgaaaatgacaggtgaagactatcacagacaaaagccccagaacacatgttttcttaatgaaccatgtggattatttactaggatgatacattaactctaagaagaaaaagaaaaccatgcctccagaaatgttgccgtatttatgcacaagcatttgcagaaaataacatctcatttaaaacaaaatggacttatcttgcaggctcagttttccagagggagggaaaaatctttaagaatatggaaataatctgaggcaagccaaatgtgttatacattttaaacattaacacgtgtagaagtaaatcagataattatagatgaaccccttgagcctcaagtggaacccatttgtttttattttatgtaccactgaaacaaactaaattacttgcttccttaaaaccacagatcagtgggagtcaatgaggacttgtaataagtgaatacattatacacttgttagaactgatatttttagattttaaaattgatgtgttaataaagataactttattgatacatgtttaaataatgagcatattttgtgtgagaagtttttctgttcatttcactaaatgtctcacctgtggagcaatccatatattgatatttgttgaatagagcagctggtattttaagattgtttcagtaaccataagaattattaagtgtagttatttttctaatgacaattcagcctcattcgtggtaatgttcaatgataactctgatgacacatcagaaatatagctagaaaacagaaaattttatcccttcctcatcttctcagagcaattcaattattactaattgaacacttgtcaatgacaacagctgattttcattttcaaaagtaaattacaatatctagttttcagaacaacatatttaatgaaatgtgaaaatgcaatatttacttcgggatgaataaaggttaagttttaaccagtttgaaaacacagtaagcaaaatggagtcactgtaatatttactactagagatgatattttctttgaaaaaagtgttgcataatattctgtcacctcccctgcattgtaaagtccacttgaatcctactctgaatatgacatttaacttccttttttctcttaaaatatatcgtgaacattcacttctataaacacatataggtttaaattatcatctatgtttcattgcatgtatatgtatattttctttaacaaaatacctattttttgacagatagtttctaattttaatatatttgtagaatcctggtttaagacgcttaactttctgaacttgcattttaccacccttaatcaaggtcttgagttaaggtggctggggaggagtgggataaagtgccatgtaaccaaatgacaaaagcttgtgagcctttgtgctctggcttaggggtgggtctgaggaagaggcaccgttttttttctttccacaaaggcaacaccatgctatccactattcatttgtctaaagatgctttctctaaaattcacagaggtgcatgtggactagacacactgctcatacagagtggtctgttacatgagagaggaaatgtaaactgtctaccacaaagtctgatacacaggagttgctctttaaatcatagctgtcaatcatagatacatgaaattaggtttagtttactttacgacggaaagagattgtattaggtgctttagaaagattttgaacattgaaaacattaacatttaaaacatttaaacattgatgattagaattttattaaaaaattttaaaagtcacataatacagtttaaaaatgaatcattaaatctatcaactatagaaaaatggatatataaatttcattacataattttaaggatagttatatagctcttgaagtactaattatgaaacatattaaaaagtggtaataaacaaaataagctgtcaaaaaaattttcttttttttttttgagatggagtcttgctctttcgcccaggcgggagtgcagcggcgctgtctgggctcactgcaagctccgcctcctgggttcacgccattctcctgcctcagcctccggagtagctgggactacaggcgcccaccaccacgcccagctaattttttgcatttttagtagagacggggtttcaccatgttagccaggatggtctcgatctcctgacctcgtgatcctcccgcctcggcctcccaaagtgctgggattacaggcgtgagccaccgcgcctgccagctgtcaaaattttaaagttgaagacaaatagtatacattccctgttaataactgcattcaaacatgtccatattcataaatactggcaatgccatgatgaatataaagtgatgattattgtagagaccatgctgaatctttcccttatgtctgttttcatggatttttatttcttaaattcctttttgcaccatcttcttgtcattcacctccccttccaaaaaaaaagaaaatgaatatgtttagcagatttttgcttcttcatgttggttcacaaatatatattctgtgttttattctaaatcttcatctaattgtattagaattttgtgagtatttttcataaaaaagtattttttacattccacaaagcaatgatatagaaacacataatgctctactgtatgccaaaaattagctacatcctacacacagctgtgaagattaccataaacatttgtgttcatgccagttcatctgtgcactggtatttaatgaacaatgaaaagcaaatatctagtcaaagatacaaactttctttttctgtatttaatttttttggaatcttgacttgttttcatagtagattatatatatatatatatatatacagagtttgctacagtgcaaagctagttctctcaccagcaagagaattaaaatactgtttatgccattgacttactctggcaaatgtatatattaactaaatataatatttcttataatatttccagtgttttggtagggaacatttcaaagtatcgggttaaatatagcaaaccaatactaactcatatattattctcaaatatatgtctttgagaaaggaagacataagaggattttgtctatcctcaggatgagggctgagtcctggagtcaataggaactgcaaagtaaagagaggtagagaaggcatttttttaaaacccaggttaaagttttactgaatgaaggcctctgcagtattatcaaaatagccttgctcattacaagcagtgtctcaccaaattgcctgggatcgagtcattctagacgacttattgtcagcagtcatttagagttgagattcaaagctgttggttataatcacaaaaagaccttaaccagggacttggcaactggagggtcatctgtattcacaccaataagtctttgtcatgatttcatgttgcatagctttgttttttattctgacacccttttattgtcagaattcaaggtagacatagttaatttagtttcttgccagcaatatctactttcactttttttaaccctagcacttacctgttttatagtgacaacttgagggataaggaacagtataatctttatttaatacttgtctctgctgagtttccaacaggcagactgttatttgagaaaagcaatttgggatataatacagtagcttaagggcaatgctccaagaaataactaatttcataaaattataggtgtataataaatatacaatgtgatttagtaaaatatgtaaagatgttgaactgttcacatcatcttttaaaatataattcttaaagagtattaaatttagagcaagaaacttatttctaagcatttctgttgggctttcaaatagggactatttttatgcttgagtgagattaggtattataaagtcaaattatttgaatatttcatataatctaaaattatttgaaacctggaaaataaaactaaagagaagtgcagataatatttgtaaaatacttttttaatttaacagatttattatttagagctatcttatactttccttaggaatacttctggtattttcctaaggagaagaatttagactttacaaaatagtttaattggtttaaacagaaaaaaagaattacatacgctacctcttcacaattccagtttttatatgctggatgtattagtattgtattgttgtataacaaattatcccaattttagtagcttgaagcaacacacatttattatttcagtgtgagtcagaggtccagatcagggtctcacaggctctaatcaaggtattggctggtctgagttctcttctcaaggctcagctggggaagaattcaggttgtttggaaaaaaaaatcatttggttatgactatatgactgaaggttctggcttgattttttttttttttctgagacggagtcttgctctgtcacccaggctggagtgcagtggtgtgatctcggctcattgcaacttttgcctcccgggttcgagcaattctcctgcctcagcctcctgagtagctgggattacaggcacccgccactatacctggctaatttttttgtatttttagtacagacgaggtttcaccatgttggccaggaaggtcttgaactcctcacctcgtgatccacccgccttggcctcaaagaattctgggattacaggtctgagccgcctcgcctggcctgagccaccacgccaggcttaaggactcttggctgaagcttgcttcaggcattagcggctcctcttagttccttatgccacatgacctcttaataagcagtttaaaacatggctgattgctttttcaaggccaccaggagaagctatgtatactagcaagataaaatcttacatctgtattgcaacgtaatcgcaggactgatatcctatcacctttgccttagtctattggttataagcaagttatgatttcctcctgcactcagagggaaaggatttatacaagacataatgctagtggcccagataaagggaccatcttagaattctgtctgctatgctgaattatttcctaaagtatttagcatattcagttagacagcaaattatatctaaatgtgtagaaatagtaatttagtaaagttgttgaaaattctgaacaatcaaacatactttcaataggtttaaaaatcgtatagaacattttatatgtaaaattatacataattgtatcagagaaaaaagaataatatgagccccatcaaactacaagcactttgatcacttagttgacatatttggaactggaatagttgtgaaaaatatttccaaaaataaaccaaaataagtattaaaagaatctcagtataaccttaagctacatgcaacagaggtacaacacaaactgtaggatagtggctactatacattgtactttttgtataacttgctaggaacttgggaactttttttttctctttagtgagtaaaataaaaggtcaagccagccttatgttgtctgtctttaatagaaaattccagagaagattaccaagctagcctcttagatttcttgagtctaaaactattactacatacaaggtttacttatttatatatatatttataagtatataatatattgataatatttatatataaatatggataaagtatgcatatacttataatagtataaaaattcacatgtaaacaaaaacaaagctatttaataggtaatgactgaattattttgatcacataaagcttttatttttaggctgtaaattatagaatgagtatagatttaaaattatcttcatcacttttctacattgacagcctgtggaaaaattatcagcctaatattttgctgaaatggcctcagttatttctaattacaacattaaaattttaaaatttatataaattttatagttctttggcgttcccagtttcaacaaatattagccgagcaccttcttataccagacacaacattagatgcatttatctaaatattatctttagataaaatgagacaaatcactgatgtctgctgtaaccgagactgatattatattactttttatatttatactggtttctctttaactcagtaatcactattttaggccattcaaggaacaaattttgaagcaaattttaaaaataatttattctgtctgtcattctttgtcttttgcattctcctccaaaagcagccttagacaaggttgttgagggaaaactggcatttatgcaaaatcagagagcacatgtgttagacatttccaaatcaagcccacatagagagggaatacagagtctgagttactgctgagcccagcaagctgcttctttgcatggtagagcagattgaaatcagcgaagaggtgttgagtagatgcagtcattttattcacttgccctctatcaagtaaggcaataacccaggcagtctcatcttttagctcctactgccaccttttagagccaccatcaaaatctggatcctaaagaataatggacagctgatttatttcttggcaattattcagctagttccaaaatgtataaaattttcttccttcaaatccatgttctgctggagtgaaggaatttgtaacagctttatagcttcatttaaaggagtttcataatttccatagcaacagataaccatgtcacatattttggaacaaggtcaagttctactccagactcaaaatgctatgacaggataattctgcagttaatggaaacaggtagaaatatagaagcagggataccttccaagacacattatatctttaactaagctcaagttcatttttaggctgatttagctctagagagaatttaagtggctgggaaaagaaaaaaaaaaaaaccaacacagattgtattaagacgctaccctaatgctgacaacctgagaaacagtatttttcgtcctgatcttgacaataaaatctgacctgtgtggccatagtaagagagtataaattacactgagggatactctttgcaaatttttaaggtatgaatattatttgtaaattacttaaccatagggtatcttgctctatcatgttaggaaagctgttggattctaaaattgccattgattcgtacaatcttaatccagcccttagattgtatcaactttctctgttagtaatatcttcctagattttgggtttacttaaatttatagattaaataaaggaaatataaaactcaatctattaggatcactgatttcctctgtaattcctacacaattctgacagtataaatgaaacttaattctggggaagttcaaaaaagacattccggcaaaaaatgagaccgtttaaatgcttcaatttttagcatttttatgttaaatgccaacatagtaagaaattacaagtttggcaaatatatttcaataaaaatataatgagaatccagtctcctgcatagaggaatgcttattacacactatgtatacattgtattattatctccttttcagaaacctcatcttatctcaatccatagaaacactatctgaaatgctgcatgtttatttattcaatattgagtgccaacaatgtgccaggcaaagctgtagggattggtaacacaataataagacaggcatgaacaaagcatgtaaaagagtggatattcctcagaataaatctggatcattgaaagagacaaagaacaaaaaaaaactttgttggacaaggaagttgactatattgtcagtttgctcaagccagaattttcccactttaatacttttgagtaattgaaacaaacatagataatttttcagtcacctttgctattagaatgtgttacgctagccgttagtagttttaagacttaaaagtacattttgggggaaacaacttaaacattcagaggagatgcttctctcagtttcaatttgatcaaacatttaatatattttcttctgaaaagtgatacttttgttcaatgtttctcaatgtgtgcttttaaatagcctcaagatgctccccccaaaaatgaatgctcaggatactgtagtcaattttcaaaaataaataataaacagagtactggattatcttcatcgtcacccttggggcatcttatgataagtgggtctgtgtgcaatgttcaggcataataagtttcggattctcattcttatctcagaagtattgtttttattattgtttatttttcacctcatataccaaagaacaattccacctaccattacagtttgctatgtgacctggaattttccttattacaggagtaggatgcgtggaatatcctggcctagagttctattaaggagtgagtgcctcttgcaatattatgtcttcctggtttgcctactaatgtaccaaatatggatattgtacatctttctagacgtaacatcaacaaattgggaaaaaaacacagatttcatgattcatataataaaatatgtcacaaaaaaataatatactttaataccttgatggtaccccaaatcttttgcattgattctaacattttcactctgtatttcattttaaaacaagtgtcaacccctagagtgtacaatgaatgtgttctgctaaactctattaacaaaggaccctatttgaaaatatgagagctaattttatttttctcctgatagaaaaaaaataattgcaataaaaaaactaaaatttaaatttccaacttagctgaattctgaatcaaatatggttttcttttcaaaacataggctaatttttgagaaaataggtttgattaaagtaagctatggatgaacttctaccttaagaattcttttaaacataatggtaatataaaaatagtattattcttcataatactgtgactttggaggataagtcaacaaggagtagaagagcaaaaagtatctgtagaaattcataagtggagtaatccattatgcatctatagtcgtaagtttgaagactacaacatttttactcatagttatttcatatttttaacaagtagagtttcagaaatacattgggactactcaatattatgtgtatatatatatatgtaaatatatatatgacaagtgcaatgtcatcttgacaacataaacaaatgtgaacattttctttaatgatttgcttctaacagcatgttcacataagcaaataaaatatttttcctgagaaaaatttatggaggataaaaaacacatatagattctccagggcccaagcactgatgcggtgtttgatatagttaatttcatgaaaaattctagttttgagatctttgaactgggccattctctttcaacttttgttaggctgtaaatttttatgaaacagtacaaccatcgctaattcagttatagctaaataattttttttattttatttttattttttgagatgtatttgtgctctgtcaccagactggagtacagtggcaaggtcttggctcactgcaacctctgcctccctagtacaagcgattcccctgcctcagcctcctgagtcgctgggattacagccatgcgccacgacgccccgcaatttttttgtattttagtagagacggggtttcaccatgttggccaggatggtctcgatctcctgaccttgtgatccacccgcctccgcctcccaaactgctgggattacaggcgtgagccaccgcacctggccagttatagctaaataactatattttaataatctatttgtgctcttagaatcatctcagtaaatgtaactaaactgaataattatgagtttaacaacatgaatgcaatcagttattccctaaacggcagttttaaaactcttctaaagtttatttttcattttttaaaacttcatcttaaatcctgtctctcatttataaatatacatcaataaattataatttctaagaaatcttaactgtaagtccttctccaaagaataagtgcatctccataattcttaattaatcaacatattaagctaagtaataaagtaacataaatgatgaaaatatgagaatatcagttataaaacatttttataaaacaatcccaagtatcaagaagaataagtttctatttcagatattcaaaaactctcccaataccagcttaaaaaaacaaaaagtaaacaaacacaaaattgttggttccttccagttgccaccttcttctcttcctcttcctttttttttttttttttgagacagtctcgctctgacactcaggctgaagtgcaatggcaggatctcggctcattgcaacctctgcctcctgggttcaagcgattctcctgcctcagcctcccaagtagctgggattacaagtgcgtgccaccacacccaactaattttttgtttgttggtttgttctgttttgttttgttttttgagacggagtttcactctgtcgccaggttggagtgcagtggcgcgatctcagctcactgcaacttccgcctccccggttcaagtgattctcctgcctcagcttcccgagtagctgggactacagggtcccaccaccatgcccaggtaatttttatatttttagtagagacagggtttcaccatgttggccaggatgatgtcgatctcttgacctcatgatccgcctgcctcggcctcccaaagtgctgggataacaggtgtgagccaccacacccagcctttttaaaatattattatttttcgtagagatggagtttcaccatattggccaggctggtctcgaactcctaacctcaggtgttccacccatctcagcctcccaaagtgcttcctctctttaaatagcaaactcttagatatcaaacttcttccaagaacactatcctcactttgcacttactgttttgacacttaaatgtggattctaacacctacctaaaacatttcactgattgtcatagatgcttcaatttccaatcttccctttctttgcctttggctttttaaaacttttcagaacctccaacaacctagagtttattttcctggattgccgaacaccatgctctcctgttttctcctatgcctgtggctcttccttcttagtcttttggtggttccccttttctatcttttctcaaatttttaaaacatttagattttgtcctaggcacttttctcaatacattcaaccttgtctttctccctagacttttatgcactcagataactgaggtttcccatggagcagatgatgcccaagttttcacctccagtgcagatctccgttctcacataccatctgcttagtagatgtctccatgtggttataccagaaactcaaaacagatttgcaattcccttgaaaccttccactattcactacagtgtacttgtggtctagcattctccctctctgcaaaagatacccccatctatgcagttgctggagtcaaaaatctgagagcagctctttttttgtgtttgcggggtgggggatcactttcattcctaatattctcttatctcttttccaatcaaacacataccaatacagttaatcatacctcataaacatttctcagctctattccttatttattctccaacctctgtgtaccacaatcattgttcttcaagactacagcaatcgtctcttaacccttcttttctaccactgtttctcttcaatctattctgcacatcattatcagaatgacatgtgaaaaagatttctgattaagtcacatctcatttagaatccattactgttttctgaaatttgtttaatgtccacagatctttacataatttcaatatctagttttatctggcctcatacttcttttcaaaatttattttattccactctcctcttgtctacctacattttagtgattctgaacactatttaattaataaagcatgtcacaatcactccagacttatgtcctgttcatatgctaatatttctgctgaaaaaaatgattttaattcccagtctacctcccacacatatattatgccagctaattcatagatgttcctaaaatctcaaatatcataagctcctgacaaattaaactttatattataagcaaatttatgtgtcaccataacattgtgtaatttgtcctttattcctccatttgttttacaatgttgatcttcttaacgggaccatacagttaatgacatcagagactaggtttcccttgcactatattccagaatctggcataatgactggcacagagcaaataatggatacatacatgtttatttaaattcattttaaaaagtttcatttgttaagaaagtacagaaatgacaacacagaaaaaaattaaacgtgtatctaacaggtaaaaattaataaaaaagtatggcaaaaatatttgtgtatgatttctatttagtctttataataacccttcaatgtggtcattataccacattttacagaacagaaagctgagttcagagaagctaaatatcttgcaattccttgtagctaataaataaatgacaagtccttattgtaacataaagggtcttttctgatctggtcaacactttcttcatcagaataaggtctttctgttgttccatttatatcctatatatcagctataagacatgattacagttccccattaacacattaatgcctgaggttgcaattttttgaatttttgcaatcagacctttgtgttgaccttgagcagtaggatataaataattcccacatgcttagcgttccaatcatggaacactaggcataaatggccaaatatgtttgtgcttctgagtctttcatcctgtttccatctgatgtgaggctattttatttcttgaccttcataccacctcccagacattggaaatcttgtttattcccttgaatcttatacttttcagttaaatagttaacattgtgatagtgtctttgtcacccaaatctagtcaaatgcccctcttctgcaccaggagcaccaatgatcacctttattttaacgtacctcactaaagttgacccttggacaataagggtttggactgtgcaggtccacttatatgtggatttttgttcaataaatatgttggtttttttttttatatttgtgacaagttgaaaaaactcacaaactgtgtcacctaaaatattgaaaaaattaagaaaaaagtatggcatgaatacataaaatatatgtagctactagtctattttattatttactaccatgaaatgtacatatatctattataaaaacttaaaatttatcaaaatttgggcacacaaagaccgtacatggcaccattcacagttaagagaaatgtaaacaaatgtaaaaatgtagtattgtaactgcataacatttactgcattatatactgttctacagtcataatttcatagccagctcctgttgctattgcggtgagctcaagtgttgtgagtatcctcttaaaacacaatgtgaggtggatcatctctgcatcagcagttcatctctccagtaaattgcatatcacagtaaaaagtaatctcttcaggttctcatgtatttttgtcatgtttaatgcaatacccaaaccgtgaataacaccatgggacccatacaaagtggcactagtgatgccgacagtactcccaggcaacaaagtcatgccattacaagaaaaagtggaattgcttaatatatgctatatagattgaggtctgcagctgaggtggaccatcatttcagacagatgattcatcttgcaaacagatgataaacacagtacactactctaaatgtattttttctcccttattattttcttaataacattttcttttctctagcttgctttattggaaaaatacactctataatacatataacatgcaaagtatgtatgttaatcaactgttattttatcagtatgtcttctgatcaacagtaggctattagtaattaagtttggggaaagtcaaaagttttatgcagatttttggtggtgtaggtgttggcacctctaacccctgtgttgttaagagtcaaccatacattgcaaatatttacatgtctcctccataaattataagctcctagagatcagatactatgtaattctcaacattatattccaggtacctatgaaagtgcctgacatattggagatgttgactatatatttatgtagtattaaataaatggatgcaagagccagggtttaagctcagatctgtctcttaagaagctcatgacttttcagtatatgcagaaaattggtaatggatataactaaaatctagtagattatttgagagtctacaaatgctgagtgaggaagaaagacacagttacaaagttagaagcatttcaaggcactttattagttatttaggaaacgactatttcatagcacaagaaagccaacataaatcacaatgtcaaaccagccatgcttgttgccatgatgccttttccaaaggaaaatgagaaactaagatatttttcatgccctttgatttgtgtgggcagaaaagtaaaggggagtgtttcaacacaataatctgttcattttcagaagaataaacaaaagctaaaggaattcacttttattagttccaaaattaatgttaaataaatttgaatgtttcacaatagagtagactttagcagacctgctgtaggcccaatgctacaaaaataaattgaattataaatatgcaactgtggtccacaaatattttttatatagttacaggatgaattcttaagtaatgatgtccctacccaagtcactatctaatggtatgaaatacaacagttttgagctacattgaccttacaggtccctcctcttacttcatgaacttcagtgcccactccagaaaaacttacatatttacttttatcttaagaaagataagtgtaccctttcatatatttttgaataaattgtaggatgttctgtatttaattgaaaggcaggcaacctaaaccttagttataatttatgccagtctttcaaccaggaccaagttttgttgtggtttactcattaaaataatatttaatgcacaagaaataatatttaatctaacattatatatgtaaaatacattaagagaaattttcagtaaaatcagtcttagaatgtattgtcatactttctttgtgaaaatgtgcatgccatactacatttgaataatagtcttagaagctgtaataataatagcagagctgtcttgtatagaaaacttgccatgaatccttaaaaataaatatatgttattttagaaatgaggaaattaaggttgaattattctaagttaattttctattatcacacaactactaaaaggtagagcaagataatcagtcagcctgtctctaaaacccacattcttactcatctctatcaattgtttcaatgccgtagaagctgaaatgaattcttgttcatcaaaaaatgaaagagaattcctgtgacctcgcccatcacctcaacattgctgcctggatctttgccactgagatgattctattagtaaaattgtaagtgagatagttctatgatgagaaattcacagtaatttcaatcaagtcatttgcattaaaataatcttacaaagaattatacactgtattttgggggttactatgagacccatgtatatcatctatacaatgtgttctcataaaacatgttcattatttcttttcatacatgtcaatgctaaatttactaagagaattacaatatgtgctgacattaacatctgaaagttattttcattttaatagctgtagctatatcttattaatattacagtcccccttatatttacacatatgctaaaagcctatatttcattctgtcttgaatcataattaattacttatgtgcctaaatacctcagagggcagtattagggaagggacaatgtttaattcttctttataacctccctgatcttagcataaagcttagtacttagtaacaaccctaaagtttggagtattaaaatccataattcacatctcatcttttttttcctctcctctgtctatctatccatgtagtttagattatttttgtttaaactacctatttatcacaattcattgattaacatatagtttagaatgttcatgtgacaagtgttcatttagatttaaaaatttttaaggaaaaggcctaaagacctttacttaagaagagaataaaatgattgagtaattattagggcatattcagtaaaattacttaatgattgcaaattgtggcaaatcgtgctttccagactagatggccacatccgtagtccccctcacaaatgttcttctttcaacatactttttttctgtcacttttcttattaagaggcagagtgtataacctctttccttgaatctatgctggtttgttattctgaatccagaggaagtgactgtaatttctgaaagtagctggtaaaggccatatatcttccatctggttctcttgaaatgctcacttagaatcctgaactgccatataagcagtctgactactgccatgctgtgaggaagtccaaattatgccaggccgacagaataaatgaagagtttctgagattacatgaagacaatgatatgcctggatatctctttccgttattctaaccccctccccgagtgtttttgttccatctactatctgactgaaatggaattagagaccctatgaaagaacttctagtcatgaaaacacacagaatatgagatataatacaatttgattgttgctttaagccactaattttttagatgatctgttatacagccagaataaatgaggcaccgatttttcttataatagaatataaattctttttacatgttttatttttatttatttattttagagacagggcgtcattttgttgtgcagactgaagagctgtggggtgatcatagttcactgtaaacttgaactctggggctcaagaaattctcctgtcttagcttcccaaactgctggaattacaggtatgagccactgcacctgacctagaatataaattatttcagaacagcatctagggataattatgtgcctacagttaatacataaatatttgctgaagacttgattagatatacctcattttggacatgcaggtcccatattacattttaaacattcatggtaactgatagaataaggaaataccaactctgcaaatattatatgcaaataatatttaattagtgtatctaatatctcttgctcatatttggggtctttaattcacaatgttcatatttaatcattttcaattggtttaaattttaaaaactgaaattactttttctgtttttacaaataatagttgactttcattttacattatttgttttaaaaaacagagcttattttttctaattttctctagttttaaaaaccttctagatattactaatgtttatgattttgacaacttttcttattgatatcttattatcaagggttaatgtcaatattgcattcattaggaaggtgtatgaataaagattctttaaaattattattttcacgaatgtttctctgtaatttttactgttagtgtggcattcaataatatgtaataaaaggagactatctcagcctatacattattaaaaaattacattaagccattactccaaagactgggaatcacttctttttgttttatgtcttgtatgtgcctttggaaagtggtaagttcaatacatttttaagcacttgtgagtagatcatgtagatcatgactagattatcttcattacttccttctctgtgaagaagaagtgtagtcacataattattctaaaatgctttttctctttcttgtagtttattcctttgtaataaaaatacatatcatttagccttataactaaagcattacttgattaaagtagtatcaactgctgtcaaaataagtttctggaaaaaaaaaatcaagcaatggtcaagaaatcattatcaaagtgtattattatgtgatatatgtgaaagttttgttatctttcccatagaaaccattccaacaatgacaaggaaagtaatcttagtaggacagggaaacttaccacacccatctgatggaatgagatgtgtaacaatccaatggagatgtgtaactacctttgctttcagtctctgtaactcagctttttgggctccatcgagatacttcttccagtcgctatgttctacatgaaatgaatcactcatcaggataaagaaagtttcgttttttagagtacattgacattccttttgctgccagcatcactccatattgatgatctcatttagtcttgtaggatgcaagaatattgcattcttttattttatttgaatcttttcttttaaagttgttctcaaagttgacagaaatcatgttgatcaaagttggccctgcctggtttaatcatatttaaaagctttcaagataataaataaattttaaattctgccttattgactttataagctttttattacaagatttttaaaggaaactatcatttacgttaaatgttgcttaaatatcctgatttgtgatgttcaactttgttttagagttcctacgagcaccataaagcaatgcgtagttaaagaaactatagtttgctaaatctgacatctacagaggatcagtaacttacactattttaagacctaggaaaatccacatttgtctttaaagccacatattatcaagtattactctcttccagccaccaccattaatgaattatattaattccattatggcaaaaattactcaaaataaagaaaggaaaatcttaagaattttatgaccctcaaagaacttttaaaggtattttgcttatgtatcttagctattttaagagaaatagctaaatacttgcatggaaaatgaaacatataatacaaaacacacatgatggatacagtacctcttttgcctcttaatacgactatcaattctttgcacttctacttacccagtcttgattatttccagaaaaaaaatttttaacaattaaatataatgtaactagcccatgctttccagttgaggaaataaaatgacacatacgtctttttcatgctaatgcaaccgtgcataatgaaatccatatcagcattttcaagttccatgtttgtgtgtatatttacaacacagttctagactatgcatcctagctaatgttaaatacctaagtatagtgttttgagcacaaccttatgtcaaaccctgacccaactatgtacattagaacctcaagatgttaggcacagtgagtcccattgttgtaggggctaacatttacacaattttctaaccctttttaataaaaaaaaaattacaaatgtaaaattagaagtaaaagtgaatatttaaaataagaaaacaaatcatgacaagctacgtttttaaaagttggcacataccaagaaaatcacaatatatagaaaaaatattttttacaaataagggaccacacatgacacagatatataaaacacatttttcttatatttatggtagtattatctttgactacctcttcacaagactgcaattttgtgatattaatatctctagtgagaatgtaaaagtaatccggtcttctggctactatgaattatctttttgttgttgttatcaacagctcagaattgtacttagcttcacaactataaattgtgagcattgtcatttttggtagattctccaccaagtttcattttgtaggaactctaagattttggaggaatttttttttatgcctgtttgtttcttttggtatggtgattaatcttaaacacgctttgaatttttagtattcatcaattactttgctacagtccctcccaggggtttagaagggcacaggagatcaggggcactgttaacttaagcaagtgagacactcattttaataacctttttatgttttaatttataaggatacataatagttgtttagatttatgaggtccatgtgatattttaatgcaagcatacaatgtgcaacaatcaataagggtaattgggatattcatcatctaaaacatttattatttatttgtgttggtaacatctcaaatcttctctgctagttattttgaaatatgcaataaattattatcaaccacaattgcccttctgtgtcactgtcctattccttttaactgtatttctgtgcctatttaccaaagcttttatagctctccctctcagcctctggtaaccaccactctactctctgcctccatgaggtcaatttttttagctcccacatatgagtgaaaccatgtgctatttgtcttcatgagtctcgcttatttcacttagcataatgttttctagttccatcatgttagtgcaaatgacaggagttcattctttttatgggttaatcatattccactgtgtgtacataccataatttatttatctattcatcttttgatgaaaacttaggttgactccacatgtttgctgtttgtgagtagtgctgtaataagcataggggtgcaagtatcttttcaatatactgatttcctttctttggatatataccaagcttctggattgctggatcacatggtaattctatttttatttttttgaggaacctccatactcctttccatagcagcagtactactttacattcctgcgaacaggaatacttcccttcctttacatcattgccagcatccattgttacttgtctttttgttaaaagtcatataactgggatgaaaaaaatctcataaataataagataaaacgcattttaatataatatatttatttattttattttttagatggattcttgctatgttgcccaggctggagtgcagtggcaaaatctcggctcactgcaacctctgcctccaggattcaagaaatactcctgcctcagcctcccgagtagctggaattatgggtgggtgccacgacgtccagctaatttttgaatttttactagagacggggtttcaccatgttggccaggttggtctcaaactcctgaccttaagtgatctgcccacctcagcctcctaaaatgctgggattacaggcgtgagcctgtaatgggttaatatattttttaaaacaccagcataaacacacacacacacacacacgcacacgcacacgcacacgcatatacatttaattttcactttgctcaggctccagtatggtcttacatggcactgcatggcagtaaactgctcctcaacttcaacttgggtagctgtatgttaagcttccctccaagagataacattaccattattattctacagcaagaaagacttacagttgttatgtaatggtaaaagcttgtaacactggtaacattccaacactgttctgagcaattcatagttgtttcacacttactccacactacaaccctgtgaaataagcatttttatatatttttatgttaaattaaatgaagggtagagggtcctgagtaatcataagtaggaagtatcagacttgaatctaatttcctctgatcctaaagtcagagctattaatggctatactgtattgctgtctaataataatgtatcttgtcagtgaaaaataagccaagtgataacaaatcttgtacccattggtgctattctacttcatttttctgcaatgaaggcttactccagcatgtaattttaaaattagaaaaaataatggaaattgtttatgactcaaaaaaaagactaaaaataattgttcttgaaatcatacaacccaagaaataatacttgatttagatttttgcaaaaagcttatttgaacagtatatgcaatttttctttcctgcactcccaaggttataacagaaaagacaaacaaatttattttaaatgtttataaatccacaacttgtcaagcatattatcaagccctggcattttcctgctatcaaagcatattagcacaatctctttattgttccaaagtttctaaggcaaaccttacatcttctgtctgaatgccagtggaagagtttccacaggagtgctctcataaaactcaagagattttatttcctttctttagctctctcactacctgtataaattcaccatgtgtttatggattccaaagtactgcctcaggatttaaacatgtgtataataaatacatgtattgaagcccactattacaggggttattaaattttataatttatataatgagcaggaagccagaagtaaaagtccttgtttgacccaagttactgtcggtttcacaactcatcagagaagaaaaaagaacaactgtggaaaagatgtcaggcatcttagatggctactctggttagactgaggctttttcccatatgctaccttgaagaaagagcacagaacagtcaggatgcatgagtaggcaggaggcgctctccagcctttgctgtcatttctgttctaaagaacaagttcccagaggcctctactatgtgatatttgtcagccaattatttgtggaataggaagaaatgggaggcaaaaacatggtagatgaagttctgcctcattcccctgacctggtaaaaatgacagagcattccccagaagcctggatttgctcttatttgtttccatggaagacaaatgatagaactttatttaaccccaaagctcagaggaaatgcatagggaggaaatagacagatggaaataataccaccacttttaccctcaagatgggaaaatgttatgttatctttctttattatcaaattgaataaataaataaaaagcctacttcttttattttttattattattatactttaagttttagggtacatgtgcacaatgtgcaggttagttacatatgtatacatgtggcatgttggtgtgctgcacccattaactcctcatttagcattaggtatatctcccaatgctatccctcccccctcctcccaccccacaacagtctcctgtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatcattttttatggctgcatagtattccatggtgtatatgtgccacagtttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacgctgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccatttttgatggggttgtttgtttaaaaagcctacttttacaatttaaatgttcttcattttggataggtttctaaacacagtcatcttgactaattagcacttaatatgttcctttttcatgccaggatatgtacttaattagtgatgttattaacacgatccatagtgcacttaaacatgtaaaacatcaggaagtagcatattctcaataatatatttattatgcatacagcctctaatactgagtgattccttgaatatgtaagtccattatgccattaatttaaaatttttcagtcagtattccaaactttctgataaaaattttaattccattgtagaatgaaacattgcctcatgccttcagatagacttagtagttagtgcttctttctgttatactataagttattgtttaatatctttatgccttacactgtagataccttgtcttttttatatttacaccacaggaacttggtaaaaagcctaattttcttatgagggagtcaataaatgtttgttaattgaaaaaaaatccaatcagtctgtaggtctgatatctggaaattttcaatcagctatattgctttgtggaaattcttcctgacataaagatagtttaataaaagtatggttaatcatatcaaagaaaattatgttcaaaatggatttaaaatggtagatgtgtgaggagaatataagatggcaagatacaactgaaacaaaaaaaaattgaaatgagattagcacacccaacagaaataatttatggttctattaaagcaatatgtcatattgtggggaatacatacatatatatgtatgtgtgtgtgtgtgtatatgtatatatatgtatgtaatatgagggaaaaggagttggaaaatctaattcgacttataattaaaagcaaaattgctgtgttgtggtaaaaatttcaggtaaacagtgggtcataattttctgttgtaccatacaaataacctgtaagatttcaagcatgccaagactcattatttttacatctacactaaaaatatgaggatgggacgttaaaagtttcccatttcctaaattaccaaagatgggctaatatataccagaaaaggcaaatataaagctattgtattactaactactattccctccctagaaggtatcaaaaattgttcctaacatacttttctagtgaacttatatgcagacttagaatttgggacatggcactttgaacaaccacaagcaatcactaggagttgtctattgagatgagacatatttgtttttcctaccaaaaacacacaaaaacatcctggttgaacttctgtgcatgccaggaacctggttccaagtgcacatatgggaatacatgtgttgtagggaatggaggccaggaaatgtcttatgatagcagatggccagatagccagttcacctctggatgacagtggctgctctaacaggacagtgatgtcaacactagcaatgacattgatatgtctcaagtgctctctcaaagaaatgccactcagtatgaagtctctcctgagtccactagccagaatacaaatatatataatggtttcaaatgcttgctcaagtaatactgcagtgaacactttattttttatacattgtcaaacaaacagcagatgataacattcaataatcctaaactgggcagtgtacgaactagtgactacaacatgatccattgaaaaaatatttttattagcctcctgagccttggtcttaaaagtgtcttcattctgctaattttcaatattgtactttttaattttaattattttcatcaagtctgcaagatagacagtgagagaaaaagcaattttcagtacacagtcttttaaatcaactaaatttcattcctttttctctcctttgggagcagagtcctgattttcaacatagaagatctggcagaaaacaactgcatcttattaaattgcctgctgggcttactgaaactttaaaaattattgtagagctaatcaccactttcatttagctggcaaagacaacagatatttagtatatctaccatgttccaagttctctgaacatgatgcccaacaatgtataagaaagcaaattttcaatatgagtaatttggaatggggatttaaaaaactttttgcgcaggtgatgaaataagtttttatatgaatcaacaatattttccccactaaacttctttttaaacattatataccaacatatatgtaatcttacattatatacatagatatgcaatcttatgctatatacaaacacatatttatacaactgaatagcttatttggaaggctttcttttgctcttggatatttcataaatgctgtggcttatcaactaccattggtactgataccttgaattaattatcaactaggttacagggaagcaaatgttttggatataatttcagtaaaattttcagtatgctcgaagcattaatataccttggcttggacccatactacccattcatagagtgcaggagagatcataagtcctgagataacattctagagttgaagagacagacagagaaagaggaaataaacttctctgggtactaaaaggaaataaatggtggatccaaaatgaaaattgaggatgttgataatttgtaaaatcaagcttttttattgtaattcaatttataacttcaatttatgacctttagccatagacttgacttctgcttaactacttccctaaatcctgctcattgatgttgtacaagatatatgtatgtgtatgtgtatgtgtatgtgtgtgtatattttttctcccaggaaaaaatatagttatagatagaaataatggtaataatgcattttctatcctcttaatttgtttaaacagagcttttattaagtacattcatacattcaattatttcattcattactttcatgaattcactaaatatttattttaagtagctcctatatgtcaggcatggctctatgtgctgggatacaacactgaaacatgacaacatattcaaatttgcattctaatggtagagacaaaaataaacagtcacataatatgggtagtggcatgtttataaagagaaataaagcagggtaaagaaacagatagccagaagtgttattttagataaggaggttagggagtcctttctcagatgagactattagcagagacctgaatgtactacacattttgggaatctgatgaagaaagtccctgtttgacacaccctcaagtggaaagattctgaaagacgtgagaacatagcatattaaaaaactgctggaaaacagagtattaaagtgcagagttgagaaatgacaagagggagaggaaattaggtttccaaggttagtttttgtacacagcccttgtagataaagactaaagacttggattttacctcaagtgtgatgaataggcattgcaatgttttaaaagaattactctgcctcttctgtagtgaagagaagtcgtaatgaataatagtggtatagtaatggttgtgaagtggaagcagagagactagatgagaggtcagttagtaacctagattctcattctaaagctgtaattgcagaactgtaaccaatgctgctactactactactactaccaataataataatatcaacaaaaaggccatactggtggaagtaagtattttatgattgcatcattgatgccttgcactgttctaagggctcaatatgtaaaatcttaagaaaccacccctacaatactagcagataatactacacttatcctggttattcagtgaatagtttgaaactcaaaaaagttaaataacttgccaaagtcgaacatctagtaaatggtacagccagaaatttagtgagcccaaattaattttttgtgctcaactccaaaggcattgagtactcactctgtgtttcaaaatgttgtctgtgcatttcctcactaggcttccatgtatccatgtgtttcctagttgtctaactcaaaaaagacaatatggaccacctggacagttgtaatttattcctgttgttttcatgtcattatgaataacccctgcttttattctcaaaagcatgaaatgtgattctaaatgatatgcacactatagctaaggctccaagatgcttttttgttgttatgcactatcacatcaatgaatggagtacacctataaatattattccgaatgtggagaaatctccccatctatttgcaaggatatctttgttcctttgctccattatttgtagggtctcatggaaagaggcttgcaggaagagagttctcattttcattcagattatccaattctattacctcaacattgaaacatcaaagtctattttgcttctaaattataataacacttattaacatagaaaaaatgtaactgttggtgggactgtaaactagttcaaccattgtggaagtcaatgtggcgattcctcagggatctagaactagaaataccatttgacccagccatcccattactgggtatatacctaaaggattataaatcatgctgctataaagacacatgcacacgtatgtttattgtggcactgttcacaatagcaaagacttggaaccaacccaaatgtccaacaatgatagactggattaacaaaatgtggcacatatacaccatggaatactatgccgccataaaaaatgatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacaatctggggactgttgtggggtgggggtaggggggagggatagcattaggagacatacctaatgctaaatgacgagttaatgggtgcagcacaacaacatggcacatgtatacatatgtaacaaacctgcacattatgtacatgtaccctaaaacttaaagtataataataattaaaaaaaaaggaaacctcatattccaaaaagcaaaaaaaagaagaaaaaatgttaaaagcaaacagcaagacatgccatacatgtcaacacagagacaaaaaatattctgtaatgatgaaaaaagaactccagcaaatcacttgtctgctttcctcaacttctagtacctcacaaaattaacaagcaagaacttcataatggaacagttaacaacaaaatcaatacaattatgcaataagaaaccttttcacaaataatttgtataccttagcaaagggtgattatccttatggaaagttaatttactcttggaagaactaggtcatcactatgcatttgtacctagtgcttaatttaataaattctaataaatataatcattcagcgtagaacatctatttaacttcctgaaaatagagatttggataaaagatacatgtaagataatttttttattcctgatctaacaaaaaattaggtttagcattttttcatgctcttaatattttattttttgtgatattcatgggaacatgaaataaaataataaggttttggtgtgacagaaaaaacttattgtcaacatttgaaataattcatgcaagtgagatattaaatacatttcaaaagacacattaatatattggtaattaaagtaaggtataggattgaatgatttctaaacagtcacattatttttttctattttaccagtttttaacattgtgatgtctgctaacttataataatacatttctaacttattccaagtgtggatctgttctacacacaacacaaattttcaatgtttgtgtgaactatatactgtagctttgggaaatacaatgactagttaagaaacaaactggcatttggtgaacaaaacaccataaccaaaagctaaatcacacaagaggaaaattatcttgaattccacatgccaatcagtatattttcatttccaggcatatttttacatttttaaaaagataaatttaattttatattgtttagatagtatagagattttactaccaaaaaaacacatttattacatgatcaattggccaccgtacttcactagcccattaataaataaaagacaaagtataaagactttactaaacagcctcaaatttaagacagacacgttaacttataatagctcagggaaaaaataaaaataaaataataaatcataactaaactagtaacctgatgcacaacctaaatgataaatatttgtatgtctattttggtgtattttccttggtatttaaataccttgaattcagaaaatataaacttgtttacagtttttctattgcctttgaagtatctacatttctaaaggttcttttatgttccaattctctatcttgatgccaagatgggctcatgaaaaacctagttgcacagctgatgtccctgtcggctgttaacataaagagactgatttggaacaggatgaggaaccccaggagaagccttggcaataatattccgatactgcccatccgaatcagtcacagcagactggtcagacctgatttaactctgagtgagtacaaataatcaatggaatatataaattgagaatatttaatattttataacatgtctactttaattaccaatttaattagatatataaacatgcagagattttgttgatatgttttaaacagcaaaatgaaaacactagatgtagtaaacaattgcctttgcaatataactgtattatgaaaggttaaggttacttttctgccattcactcatttccatgcccacgtgcataccatagtgaagatctaacatgctatttagtcctaatctggccagtacatttgtatggaaataaaaattgtgttttctgattatctactttatttcccacaaagatatgactttggtcaccagggcaaccacacaatacaatatggatggttcagtttgaaaatattaccactaatggaaaaatgaggacccttttattactggataattagtgcaatatgacaaaaaacattatctctgttaacagataaaaatagagttctgttaggagtgttatgaatgatgaggtaaacaaatatcacagaagtggtgacactataggtcattcaacatcatagatgaaagagagctcaagaacttctagattttatgtaacattttgcaggtaaggaaactaagacttttttgcaaggagaaactaccaggtttgtacagttaataagtggcagttctatatttatgcaagaaaaagggactaagaaaaaagcaaaatatattatttatttacttatttacaatataccaggaacatcacgtatgttatctaatttaattccatcacatacgttatctcatttgattcacctaacaataccatgatgcatttatcattggtcatgtgttactgatgagaaatagactttcaagaagagtttggaacagttaaactactctctcatgattgcatcattattaaggtgtagatgttacaaagtatgataattaattttgtttattaacttgtctaggcaatgctgtccatttgtttagttaaacattagatgtttctgtgaaggcattttttagatgtgaatgacatttataattagtaactttgagtaaagcagattaccctccacaaagtgggtggatcaccctccatggcatggattcaaacagttgaagttcttaagaacaaagactaaggttactgaagagggagaaattctgcctcaaaacttcaacaatgaaacctttcctgaatttccagcatgctggcttgcaccatggatttcagatttaacttttgtctgaattttcagccctacagacctcccctactgatattggacttgacagccctcacagtcatgtaagccagttcctaaaatcagtctctctcattcttgttcttgctcttgctctcccctgttagtctctctatctactttattggctctgttgctatggagaaacttggataatacacaatgtgatataaaattattcacagtcaatatattgtgagtaccaactaattagagtgaatgctagtcttagttcgtgggagcctgaaaggctgccttttatgttggggctttcctcttcagtgtttgatcatgggtagatcgggtgttttgggagttagggggaattgaccaattatgaatgaggactaaaatattttaatatttttaacaataatatgatcaaattattaggctcctgggctatagaatgggagaaatcttctttggttatgttaatgatacttattggacaagttaccacaactgcttagtcttaatttcttcatctataaaatggagatgttaataatatccatgctaaatactggaatggacatccagtgcctaacacattgcctactacctatcaaatagtaaaatatatctaatattgtttttactacctttttttttttttgagatggagtctcaccctgctgcccagactggagtgcagtggcacaatcttggctcactgcaacctccgcctcccaggttcaagtgattctcctgccttagcttcccaagtagctggtgaaccaccacacccagctaatttttgtatttttagtagagacggggttttgccacgttggtcaggctggtctcgaactcctgacctcaggtgattcgcccgcctcagcctcccaaagtgctgggttatagatgtgagccactgcgcccagcttattactagaatttaaactcagatctgtaataatttgcaaaactcacattcttacaatatgtatgatagctgtgaaaaaaacagaataagaaagaaagagacaaggaaaaaaaagaaagaaacaagagagtgacaagaaaaaataattctctctattagaatatttaggattttaaggtataatattgaaacaaacactctatactatagattttatgttcatttaagatgtcttagtttatgtgatccatttagacaggatttaatgacccacaattattgaaacattgaaagtatgttacttttgcacttgtcctgcctatttgtgaaaatgaattttttttaaagtggcaatgttgtttctaaaagtgtctgcctttctaccctagcatgcactgtgttaatctctgaccatcttaggctcatgctgatacagcacccattgtatttttaacttttaaaaaatctgctgaggatctctatttcatgcagcacatggattgagagttaaaggtcaattaactgcattgttcatgccctgtggtttcttactgaagaatgtgaagatacaattggtagtgaaaacctatactgatgaagctcagtgctcttatagtctaaagagcaagaaaatgatagtttggtcacccactcaataataatattatgttgaaaagagacaatagcgaaataagaatttcaaagaacaccatcagtagacttcagcaggagaaggaatagaagcatatcttcatggtcgcaatgaattaattctagaattaatattaatattttttaagcatcagcattcatctataaacccacaaatttgtcatttattatataaaatgtgtctatcgacttcctgttggttttgccaagttcagaagtttccattcacataaaaattatttctctctctccttctccatctctctttctcatacatgcacacacagtattttttatgtacatccctatacatatccatatataatttccataagtatacacatattctcctacagtcatagacacagttccccagtacatatccctactaagacaaacaccaccaacatacacatccccaccttgatgcacatggaaaccaacatgcacattccaaacaccaggcatttccttaaaatacacactgccatgcacacacaccctcattcacatagctcctgtccaattacatatcaaaaatatttatgaaaaaaccaatattacagcattcagaggaaattcatcaatattcagaaaaatatataaaattgtaaaatttaaaatcacatagcaggaaattttgagctatgtgtctgtagatagattatagattctttctctcaaatacctgatgaaataaactgtcacttataaaagaaagaaagatacggtatttttttaaaactcccaaaatataaacaaacagacatcacaaaattaaatgcaaacattctcaatctctttaaaagataccagcgatagcacaaagacaaggtggaaaactattgtcatacgttttaaagaaatagaataactcattgctataaaaaactgaaggttttattgcaacacaaaaaagttcctaattctattctcactttgcagaaataattataataagttaaaaaacatttgagattcatcaccaatgtctaaacgtctgcagagaagataaagagttagtggagagggatgattaaaaaattagaattgaagaacagagtctaactctatctgacagattaaaaattccaaggctttaaactcagtagactgaatgatcagaaatggagagcattcctgactggagtaaaataaatgtcaaggttgagtgaaacttgtttttagtacatttaataaaatctcgatcttgttacaaacacacatacgcatacacacccacacccacactcatagctgtacagtctccactgagcatcatcttcaaaatagagaaaaatatattttatatttgttgaggagaagtaatccaccctatactgcaattgttacacagttgtaataactaagcaataaattcaaaccttgaaaatggtgtgattttatgtgtgtgtctctgtgtgcatttgtgtgtatttttttgaaaaagatataaataatctagttcacaaaaaattagctgagaaaaaagatataatctcactagcatttttcacactaataactactttaatatgaataaactaaatcaattcaaaaaagataacaatagattgagatgaagaaaaaattacagtgttaataaatggtttaaaattataccattgcagaactaataagtaacaaatagaatgacaagctgaaaattaaactactgacaaaggggaaaagtttgaaaaataatcaaagtgagtgcaaaacagaaaagatcaaacaactattgagaagatctccacataaaattattgttattatttaggtaaaaattctaacaaatggatcagaaacctgttgaaatacttcaagaacaattttctgaaaagaacaaaacgaagaatatttttgggaaaagaaaaccatattttagaaatgttagatataaatgacaatacaacacatttacattaaaatattgaataacaagtataaataagtttttattattcaggaaaaaactaaatttcattaaaaagaaagatttaaaccatcttgaaagtttttcaaagttagaatcaaaactaaaagttagtagacaatgtctacgaatttgtagaggaatgaaataatactctaaatatgttacacccagtcaggacattgtttttgtataaagtaaacaaaagaaaataaaaacaataaaaactaatgtaattcccatgagttttagggacacatgtccccatatacacccctaaacacacacactgcgccaattgcaaaactaggatgaataataaactcaagtagtattagaaaaaccatggttaaaagatgaaaagtaaatttgaatccaactaaataagaataaaacctggaaattatgatcacaaaattgaacttaattgttgtaaactgttacttttttaaaaaaataaagtgatttataaaattggaaagtgggaaaaagtaatcaattattattacaatattcctttgaacgagtcaatctaaactatgtaaattaaaatgtagtcaaaaatataatagagtgatgatgtcagcaaaatggaagaataggagatcccctgctcatacgccactacagcaataattcggcagccattcatgaatgaaaatgcctttgtggaagctttggaatcgagatacaaggctgcaaaactttggtgatatacaaaatagaggagggtcactttgagaaagcaagtcgataccctggctaccaactgtagtcctggctacagacccaaaacagtcccatctcattgtggagggccaatgaatgagttacttacacacatgctctgggaaaccgtcgtgttaaactcagccctggctccaacccctttcaatcataacctaggaacagcctttcccacctaggaacatgctagaatacatacttgtccaagtattctacatacttgtgcaagtatgtagaatacatacttgaaggaggttcacctaacttagtcgaacgacagtacttgacgaggtcctgtaacccagttccagcccctgccagctagagtctaggtctgggatcagtcctgtccacctagtgatatggtttgactctatgtccccacccaaatatcaccttgaattgtaatcaccataatccccatgtgtcaaaggagagactagatggagataattgaatcatgggtgcagtttcccacatgtggttctcgtgatagtaagtgagtctcatgagatctgatggttttagaaaaggcagttcccctgcactcgcttacatgctttcccacctgccattatgcaagaggtgcctttgcttctccttcatcttctgccatgattgtaaattttctgaagcctccccagcaatggagaactgtgagtccattaaacctcttttctttataaattacccagtctcgagtatttcttcatagcagtatgagaacagactaataagcctagaaacacaccaggagacatgcttatttgtgtcactagaggcagacccacctaactgggtaccacagcagattctcaaatggccatgtaacccagatacaaacctacgcagctgcagtctaggagtacatcttcccaccctctaggaggtatgtcgctttgtgtacctagaggcaggcctgtcaatcttgatcttagtgcagatcctgaagcagccctgtaacttggcgccagcccctctcagctgcaatctggaagcagttctgcctggccagaaatctatccactgactcaataggaaacctcatagggaccagacaggattcatgcccactctggtaatatgtctggcaactatggattccattgcagactacacagaggccctgtgactcagctctaatcccactcaactgggattgtagaggcactcctgtcaccctgagaatccaacaagaagtggtctttaactgctaaaaccagtctgtaaaggctaaaagaggtttacttcttcaaatgcacaaacatcaatacaaggctgtaagaattacaaaaatacaggcaaacatgataccaccaatagaaactaataaaactcctataattgaccacaaatatatagagatctatgaactttccaacaaagagttccaaataattactttaaggacacagataaatagttaaacaaaatctgaagaaaaaacaatccataagaaatagaagtttaataaagaaatagaaaccataaaaagagattcaaatagaaatcttgaatatctgaagctgaagaatacaataaaagaattgaaaacaagtaatgaagatctcaaatagattttattatgcaaaataaagaatttgtaatcttgaaaactggtcatttaaaattagccagttgaagaaataaaggaaaaactgtaaagaaaatttagaggatccatggacagcatcaagcacacaaagtatgcattatgaaagttccagaaaaaggagagagagaagggtagaaagcatattttaagaaataatgactgataacatcccaaattttgggaaagatatagacattaagattcattaagctcaaaagactctaggcaagataaacccaagaaagatcatcaagagacacattacaatcaaattgccaaatgttagaccaaacagtgaatttagaaagcagcaaataaataagcaactcatcacatacaagggaaacagcataaggttatcagcgtatttctcagcagaagccttgcaggtcatgaaagagtggaattacatattcaaagtgctgaaggaaaaaaaaaatcttgccaaccaacattatacctagcaaagatgtccttcagaaataaaaggaagataaaaacatcctcagaccaaacacactatcaaacaaacaaaaaaaacacacatgaacacacacacaattaaaggagtttattactattgtacttgccttataataaatgccaaaagaattctcaagttggaataaatggacactaagtaacaacacgaaaatatatgaaagtttcaaactcactggtatagttaaatagacaggcaaattcagaatactctaatactataatgaccgagcatgaatcagttttacctctagttgaaaatttaaaaatcaagagtgttaaaaataactacaactacaatcattttttaatggatgcacaaatataaaaagaggtaaagtgtaacattgatagcacgaagtctgggtgggagatgtaaaagtgtagagtttttatagcaatttagttaagttgctatcagcttagaatacatacctataactataaaatattttatataaggtttgttgtaaccacaaagaagtttctagtaggcacacaaaatataaatagagaaaaatcaaaagaaagtagtggagaaaaatcatcaaatcacaaagacaggaggagaaaaagaaaggaacaaaggaagtataaaacagtcaaaatattaacagaatggcaaaactaagtccttacttattaatatttaagtttaaatgaattaaattttctaacgaaaaagtaaagagtggccaaatgaatttcaaacctctaacaatatgatacatacaacagactcaccttgactttaagaatatatatagtctaaaatggaaggaatataaaggatagtctataaaatagtaaccaagagagagcagagtaggaatacttcgttcagacaaaatagacttgtagtcaaaatctgtcatgtgacaaagaaaatcaatatataacaacaaaagtattgattcatcgagaggatataatgattgtaaatatatatgcacccaacaatagatctaagtatataaaggaaatgttaacagaactgaagggagaagtagacagcagtacaataatagtaagagacttcaccaccccaatttccatactggatagatcatccagaaagtcaataaggaaacagcagactttaataatactaccaaattgagctaacacacatgcacagaacattccacccataaacagcagtatataagttcctctcaactgtacatgaaacattcttcagggtataccatatattggaccataaaacaagtctcaacaaattttaaaagacagaaattatatgaagtatgtttctgaccgcatgatatgaaactaaaaatcaacaaaaggaggaaaactggaaaattcgcaaacgtgggaattaaacaacacactcaaaaacaaccaatgagcaaaagaagaaataaagagagaaataaaaaagcatcttaaaattttaaaaacacaacatgtccaaacctcttggacacagcaaaagctgtcctaagaaggtagtttatagtgataaatgcttacattaaggaaaagaattccaaataaatacctaactttacatatcaaagaactagggaaaaaaaatcttttcaggcctaagttagcagatgggcagaaataataaaaattagagcaacaaataatataaagacaaaaaaggaactatagaaaattttattgttaaatatatttcaataaagctggtaaaaatgcataaaagttttaaaaataatggctttaagctaatattttctccaatttacattaattttaactgaaaaaaatttaaagttcaccaattacttcaatttgcattcagtttgttttctaaaataaaaatagaaaaaattaacatttcaattaaatatataatgcatattattacaatcattttttgaagacatttgtcattttaaacagatagatctgtagcactctcttattcttcctgcatatgtgcctatagtgatgtctagactgataattacctgatataaacaatgtttatttttatatgatgccatattagttctgtattgcttaagttcatttcaataagcacatatgctattttccagggggaagagggtcaaattaagagaataaatcacatcataggaaataaagatctttagttatatcgaggaacttgaaattggacttattctcttatgtaactacaaaattcataaacgttcatgataatttcaaatctgtcaagctactgaaaagagaaaggaaaagtgtgtgtatgtgtgcgtgtgtgtgtgtgtgtgtgtgagacagagagagagagaatatgaataaatgagacagatttaattggtagagtcttcgtaattttattttttctccatccagacctattgttaaaattattaactattagcaccctttcttctacaacatatcttttgttaatgtctccctcaaatcatttcctctgattctagtaactcacacttagtaatttgtgacctgcccgtctgcatccatttcttagagcaatgaatctttgctactccatcaaggttcaaaactcaggaggaaaccttgtcattaaattctataaggaaatcatctaaggttctaattttaaaatatgttttgaaattctactaagatattctgtagatgtgtgaggtaagcatagattaggaataatgtaaattgctacaactatatataaagtcaaagaatcttaatgtatttgtggactttgtagttagtctgcttacatccttgctccaatttatgtaactacaacagcgattatcttatttattttgtatacagtcagtaaaattcaactttattttgtatggtattacctcatataaaaaaatctctaggacacagactgaagcatcttttggataatgaaagtcttatgttttctagtacaggtgtttaatagcaagcagctttcatatggaaattccagggtaaataggtttgctgttgccaaaggaaaaggaaggcaggcattattgggaggaaaataaaaagaaataagtgtcatcgtatgttaatgtaatgaaaactgactatcggaaagaacaaagatatcagagctgaaatatagtccatctccagcttatacgatcctttaagggtcaaggagctctgacacacatttcaaatagttttcaaaatgtaatactgagagcataccctcagcagtatctcagcagtatccagaaagcccttaaaagtcaatcttaataaagcattcttttcattgttgttgtatcgtttggcttcatgaactttagggagaactgaacaagtaaagctgtgccctggcagttgaaaaattggcatggaaaataattggcatcctgctcaagggagagggatttgagccaaacaaaggtacctcctatattaatatgtaagcttaacaatcaggcaaatctaatgccgccagacttctgggtcagaatattaacatttccttctgacatgctcgagctggagtttaatgccaagaaatgcatttataattagaaaacatcttaattgtgatttatgtgtgtctgacaggctgacacttgatctttacttactctcttactgacttaacgttatttttatgtcctgagagacataactcaaattgaagattttgcttgtcgactttatattctgatagttatttagcttttctacacacacatcatacatttgctcaattcttatattttaacattttataacatagagtgaatttcattaagatgatttcattaagataatttgacgattgttaacatgacaaaactagtcaaaagagtttgcttcaataaacgtagtaaataaagttaaaaagtagtaaaagtgctagacaagcaattgaaatttctgaacagttccctgatacatcttacggggatcagtgttttgagtccccagttggaaaatacatgacaaatggcaatgaacaattggacaaatggcaattggaaaatacatgacaaatggcaatgaacacaaaaatacgatttaacatgtcttgtgactgtttatcaaaataggaaaatagttttagcatagaatctcatttcaaaatataacacagagcatggctgaaataacttttcttatatatttcagtgttatcctactgagttaagaaaggcatgatttaaaagaggtaaaagtatgtccacatcattcaaccacaggatgaaggctaattatatctacacagccagttccatttggcaaatacaaatagataagaggtgctagtgatgattcagatgccttggaaagctacagtaatactttcacaaatcttattttttatgaaatataaatgtgtgtgttagtgaggggagagacagagacagagaaaaagaacaaactatttgttaaaatcaagatacagtacattttgaggagatgctagaactcaagaacaacttaccttgttaactggagccctgctatttatataatatcactctccctactttttaaacagaaatttaggcatatgccttcatagtgctgacacatatatgctttccctcactcttgctttgatggattcacatatatgctttccctcactcctgctttgatgggatggattcacatatatgctttccctcactcctgctttggtggatttatgatggattttcttcactcgtgatttggtgcatcctgagtaaaggcaagttttcttttgctttttttttgaatattaataatttttcagaaatatgtatccacatgcagcagtcactgaaaacactgttaacactaagaagttcagaaataaaattcaatctcactgcctcaatgttaactattaaaataataaagtttatgaactttgggagaacttttcaataaatttccactatgaatttgatgacggccattatgcatgcacttgatgttttttcagaaattttgtttcaataatgacttttaaaaaaacgtagccttaatttaaatgtttcagagcaattacttttattttagcctcaaaaagcagaattaagagcaggctttttaaaattaccactactttcatttacttttcttctgctttcctgagttctttttaatgaaaaatcatgttgaaattaagatttataattttaatttaaaattacgtttaataagggattttaaaataattcttagaatcaaatcttttagaaaaggaaaagcctttttttcttttttcttttttcttttttttgcaatgtgcttaattacttacctgaatgttcattatgttaattttataattttaagtgatgtttaactcattatggcaagaaaatagcacagaaaacaatggaatagctattcctgaattgccacataatacctgggagaaaactaagggttttctggcttgaggaagacattagtgtacttcacaaaagactttggttgacagggaagtgaatactgaaatccaaaaggagatccacttcccattacttgcttcctcgatcaaggttgggtcaaactagagaatgaaacatgttttggatttttctctacagagaaagttgccattccgtaatttgaccaaaaatgccagtgatactagttaatttactgaaggatgtggtctaaattctgcatgtaattgggcagggaatagccaaagccttatacaggcttttattatctattatattaatattctttatgaagtcttaagagaattgaagttttctgatgcttcccaggataaaattttgaatagacagagaaaggctcttgctgtgagaaagtttacattcagttggacatagcaaagtgtaatacgaatggtaagaagagtgaaaagtaacccatgagaaaaatgagacagctcggggaatgaatgtaaagatgttcactgtctttaacatgcaatttttttggaagtcaaaatgactggatattgactgaaataattaacttcctaaatactagattgtcaccacatccaatgcctatgaaccaggtaaataatttgaaatacagttttccctgaccagaaatgtattttttaatctaatgactgtgtaatatttccacttaaaaagcgcataatttattttctaaaaaccatttaatatggttttatattcttatactaattacttacctttactgcatattaaatatgacaccaaagaaaatctagtaatgtctgaaaatgttattttccccaatttgcttgttgatattgctgctatgtaactgcatcactaataccacctgcacttcacctggacatattggaaaataatgtttcaatgtaataaaacacacagtatcacaagtgttatcaacatgtttttgtatatttttgctcattattctaaagtttaaaagaatggataatcttctagaaaaaaattttttaggtcaactattaaacacccatgtgtgtggccacttcaatggcaggtccctcggggtttgttaaatcattgccgaatgaatgaatgatgaataaaataatttttctgtcccaacttgaagctattcatgtgtctcttttatattagggcctgattcttctacatttttgaaggttttttgagggaggtaaggtctttgaggcagggtggggaaatgcatccggcaatctaccattcggccatcataccaaactcaacatcctttttaacgtatgaaaaaaatctaccttttcttctcatttgtttaacagtgcagcttttcttcttctttttttaaaataggaattgcgaggaaaggagagctgtgcaaggatatattgtcactgctaatgaatagaacttggcatgactttccttccacctgtaaccaattattaagccaaaaccatttcctgccaatacactaattgttttaggtgacaggtctgtgaattcattgctgcccaacctgactaacccttaaggaaaaaaaataaaattctataaaactaagagatagcagaatagatgcggatgttacactgcatttgagtacgatataaggtacatataatgcacgtgttgtacattacttcatttacattatcacccatatcatttatcctacgccacatcaaagtttactgttggaaagataattttgtgaaaagttaattgcttagaattcttggcctcagcttcaaatgagtgaatatctctgaaaggtttgtcactgatccaccttttgaggattttactaactgctccctactggttctttttaaatatgtgaaaaatgcatagactttgtctgaccttcatgattcataatcatgaagactaaatcaatttgcttgctttctgctatcttttaatctaagtagcactgtcctaataaaacaaaacccaaacttcacatgttttaaatgaagtgctataaaaatagacttgcagtatcgcattttagaatgttactttgaggtatttttctcatgtatactgtagccttaatatgtacttaattgtcttatattttaatatattttgtacaattatattgttcttttattaatattttatcttatttttcccattaagactaatcctcctttttaagtatagttttactcttcaactacactcagagtaactctgtcctccaaatacacatattccacctagaatctcaggaatcaattataatttacctggaattaaattgaataatttaggtgttgtaacactgtacaccacacaatacacttcaggacattgttttatctgctctgtgataactagcatactgaaattgtattaatttttactctacttacaaattaaatttgatttaagccaatggtggaaagggatatgagaagggtgtggttgaataaatgtgtattgagcacccacatatatgtctactattttaagcctcattaaattcactagtatttttctccattacaaatgagaatactgatgttcagaattttcaagaacattgctcaaactgaggactgctaacccatggcaggcacaggacttgaatatactgcagtctgatggccaagcccatatactttgtatgatacagtactgaatgttatgaatgttccctccaaaactcatgttgagacttgatttctaatgtggcagtgttaagtgaagtatttgggaggtgactgaatcatgagggatctgcctagtgacttcatgggttaatggattaaaaggttaataaattagtccagtgcattggctcatgcctgtaatcccagcactttgggaggccaaggtgggcaggtcacctgaggtcaggagtttgagaccagcctggccaacatggtgaaacttcatctctatctaccaaaaatagaaaaattagctgggcatggtggcagacgcctgtaatcccagctacttgggaggctgaggcaggagaatccttgaacctggaaggcagaagttgcagtgagccgagattgcgcctctgcactccagcctgggcaacaagagcaaaactccatctcaaaaaaaaaaaaaaaaaaaaagctaattaattaatcagttattacgggcatagaactggtggcttttcaagaagagagagacttgagcatgctaacatgtagcacactcagcccgcttaccaagtgatatgctgcactgccttgagactttgcaagagaccccaccagcaagaaggctttcaccaatgatgcctcctccatcttggacttctcaacctccacaactatagaaaatgaatttatttatttataaattactcagtttcagttatgctgctatatgcaatagaaaacagactagtacattgaccctgatcacaccactgttaataaaatatttttagtgcttttctgtgcctccattattttagaaacttcacatatatttatttcattcaatcttcaagaatttgttgtaaacctgaggcattaggactaatttcagcagagaggctagatgaggtcttgctgaaaatgcagtatgtaagctgaatcatacaacattattaggatttagccaagtgaagactaaagaaaattgaaaggcattccagggagaaaatgctatataaaattatttatgatccatatgccattgatatggccgaacataaactttattgccctgcatatcttaatttgttatctataaaatttaaaaaaaattacgttgaataattttgcttttgctaaattacgtgtttccctttcttattaatacatatgctaaagattgctttgtttctaataacatgttcagttaaatttgtagtaaagcttagtaaatttcaccttcttctttcttcaatgaaaaaaaaactacgctttctgaatttcagcccatttttgtctttagcatgctgttaaatcctcacaaaacctttctgtgtcttcttctgcttactactgagccctgggatctgagctctttgagtcaagcctttgtaagaaatgatggcttaattatcttatctgctttctttttatcttcccgacctttttccaaatctcttggctgtttccctctgttcctttgtgaataaatgcgaagctttaatttaggccatttttcataacccatgcacctactgctaagtcggcactcatctccaggttgttctgccctttgtcactcggctcgactactttccagaatgacctatttccgctggggcttttgattcactggccatccatataatactaaaagtaaaaatgactttctaattattgttatgatgatgggtgcattagtttttatttaaagtcatacaacacccacccaatcatattattatgttggtgcaaataattgtggtttttgccaatcatttcaaaggaaagaaccgcaattacttttgcaccaacctaaatagattggaatcaaaatgaagttgactataaatacttccagagtggaagtcttgattgatatatctttgaatctttaatatttatcaaatatttacaatgtggttgaaccgatttgtggttttcagttaatatcacttaatattcataattaggattctatgactatttgaagggtatatcatgacctgatctgtgttaggataaaataaatggtgggattgggagaggtatcagatactgagacagaatttaacatgttcacagagattctgagacaattgtctaacaatctatggataataaattctttaaattttgaaaatttaccaaattttcaaaaatgtactttagttgcttaaacatataaagcaatatatatggcataaaacgatttttagtgacttttaataatatctaccaattttttgctaagaagatttttcttagttctctcagcagcatttacatcaatactcgatttgtgaaatgataaaaatcataagatggtttggttttcttaggcatatatatttttattttttatttccatagaatttgtgggaacaggtggtattttgttacacgagtaagtttcttagtggtgatttgtgagattttggtgtacccatcacccaagcagtatacaatgggcccaatttggagtcttttatccctcacccacttcccaacctttcccctggagtctgcaaagtccattgtatccttcttatgcttttgcatccttatagcttagctcctacttgtgagtgagaacatataatgcttggtttttccattcattcttaggcatatatttaatatttgggaatgtttgtttcataatgtatgtgtaacccaaatttcagcagaagactgacaccacaaccctgctatattcattatgaatataaaattgaagagaaaggttccaacacagctacataaaattgaaatgccaaagttttggttattattgctagaagtacaaaattaaatcacatatgctacttgagagtttgccaaattataatgtaagtaattacatttacattccaggaaaataatatataaaacatctgaaaaattcagaagttgctgaaacaaccctatatcagatgaaacactaaaatgttgatttctaacaaggagcaattggaatatatcaatgtggcagttgactgtagagggctttagcatggaagagtaagatgatcaatgcagaaataaggaaatgtgaaatcttagaaagtatcatataacacaaactgtgactagcgttttagtttatatgctgatcataaatatgatcttttgatttttcagagctttttcaatatttggaaggcaaataaggtattttgaccataaatatggaaaaaggatcaaaaattaagtaggccagatggataccccattctccacaacgtaatcattacacattgcatgcctgtatcaaaacatctcatatatccccataaatgtatatagctactatgtacccacaaaaattaaaaaaggaagttttaaaaaaattagtcaaaaatgctaaaaagactaaaaaacaagtatggaagatacatttttaaaatgacaaaataaatattatagtaaattttgactactaattactataaattattaataaatatggtgtttgagatattgacaaagtaattcttgagataacagacaaaagcataaaaatagaactatggaaactgtcttcagagattatttaacaccagtcaatataaactaacacaagcccttatggtatgctgaaacttttattactggttaaaatatattgtctgagtattttatgtgtgtgtgtgtatagttgttattgtcattttgaaatggagtctccctttgtcacccaggctggagtgcagtggcatgacctcggctcactgcaacctctgcatcctgacttcaagcaattctcctgccttagcctcccaaactacgcctggctaatatttgtatttttagtagaggcggggttttaccatgttggtcaggttgatctcaaacttctgacctcaagtgttctgccggcctcagcctaccaaattgctgggattacaagtgtgagccaccacgactggcctgattattatataatttaatacaaattttggtaataaaaataaagttttaaaataacacattttatagaaaactggtaaattggccactttttgaattggcctattcttatactgagctaatcccctatttggttgaagcatataacaagagtttaaatttaatacatacattgctgctaatcagaaaggtagtaatacagcgtttattattttccaaagctctgttatattggcagatgtagaaaaatgagcatccaaggtctgcagacataagtgacaaagagaaatgatcacaaaattatttttggtatctagggagatcacaatgtatgaatgaaaaagcataatatgtatattgagtaaattgtttctaatggttttattcttgctgagttcttagaaggaaatttccatcagctgattaaaatggcaatagctcatctccaccctggatactgtccctttcagtaatatataacctggagagacacaaacataaagtgattactgcaatagaaggtggaaaatgcctcttaaagaggatatgagattatggaggatgtgacattaggccagggtacacactgatgttatagaaaaggtttcccagagaaaatatctgagctttctgccaaaagagaactcctacaaaaaatataaaaagaaactgtggtaaagtgtttgaaataagtttattttaggccgggtgcagtggctcatgcctataatcctagcactttgggaggccgaggcaggtggatcatgaggtcaggagttcaagaccaacttggctaagatggtgaaaccccgtttctactagaaatacaaaaaaattagcagggtgtggtggtaggcgcctgtaatcccagctactcaggaggctgaggcaggagaatcgcttgaacctgggcaacagaggttgcagtgagctgagatcacgccactgcactccagcctgggcaacagactgagactctgtctcaaaaaaataaaataaaataaaataaaataaaataaattaaaataaaagtttattttattttagttaatttggtatacagacagatacataaaaatcttaaaatgccacactatcaatagtattacaggcctggtgcaatggctcacgcctgtaatcccagcactttgggaggccgaggcaggcagatcacccgaggttgggagttagagaccagcctgaccaatgtggagaaaccccatctctactaaaaatacaaaagtagctgggcatggtggcgcatgcctgtaatccccgctacttgggaggctgaggcaggagaatcacttaaacctggttggcggaggttgtagtgagccgagattacaccattgcactccagcctgggcaacaagagctaaactctgtctcaaatatatatatatgtgtatgtatgtgtgtatatatatatatatatatatatatatatacatacacacacatatacatatatatacatatatatatacacacacacatatatatatacacatacatacatatatatacacacacatatatatacacatacatatatatatacacatacacatatatatatatacacatacatatatatatatatatagtattacaaataactgctcccattgttgaataaaaatgccatgttgagtttgtagaagaaatctcataaatctcaccagcccacttcatgtgtgtatttaccaaatataaatcaaaaataccttccttgtattcctaaaattaaaaaagctctggaaaaaaaaagatttttttttcactaaaattgtttttaaatgcatttggcagcaaaacttgaactgaatagacaggttttctagaaaaatattaatgggtatgatgtgtaatatctgtcaggaacccatcaggaggattacataatttattggatatgcatcatattacatttacaaaacgttcttttcaagttttaattttgaaacataactggcagcaaatgtttatgccacaagatctttggggtgttgtttttatggccagaaacctctgtggctggatgtgcttttgcccaagttttgctcaggcccgctgggttcgttttgcccacttggcctggcaggctgtgctaggcttatgctaccagcctgggtcccatgcctgccaaaggcgagtcaggcatagaatggcgaggggtgtgtgagcaagcatgggatctggccactgcacacagtcagtcatgagagctgctgcagcgggacgggcagctcctgatgctaacataggcactgactctctgcaaggctgtggccaaaccaggcacaccacaagcagcttccatggctggcaccagggaacatggttgctcctggaagcttagagatgccagaaactccagggccccaaagagggagtcacagccctgactcagggggctcccagagggctgcaactcttctttccttctcttcacccacaatatggtgagcaaggggcatgtttcagccctatttgtgttacagttattttagcctcctttgctccttccacggtaaccaagttattgtcctgtgcccaggaagaatgaggtacatagacaactggagagtgagcaagacaaaaaggagctttgttgagtgataaaacagttgagaggaaacccgcagggggagctcctttctgcagccagagtgtcccaatgagtgttcagctcctaggagagtggagaccctggagtggacagctcctctctgcagctgatcatcctgacatctgctgctctctgcagagaggaggccatggtgtgggtagctcctctctgcagctgatcatcaggacatctgcccagctctggctgatcccagggcttttatgggcctcagagtggaggtagtgcatgctgattggtccattagtggccacgggcaggccagagaaggcacaacaagcccccactctggtctgcagaactggagcccagcccccagccttcaggcactccctggcctgaaggtggggcattactggggacccacccccttccacccaggaaacctgtctaccttctgctgcctccatggtgcctatgctgtagatgccaaggggcacctgcaggccagttccaagctatgttaaaaccccatccacgtttctcttaggcttgtcactggccaaagtttggaaggggctgaggctgcagggggctggcatgtcagcactgacccagtgtgtacacacacacccgggctcgggcctgactttactccaagaacaaagcaagtaccaacagcagggagaagccaggcagtggtagcaggcattttcaagcttgcaagggcaggggaggccttcccaggcctctaaaggtgcagggatgcctggttctgcaggtgcaggagcaggagacccaggtctgcagctatgatgtgggtatctgcagctgcatccaggaggatgggactcctgcttgctcttggctctgagagcacagggaagccagggtccacagccatggcttgggcagctgcagaggcacctggggagctcccatcccaactcagaagagatggggccactcctgatggttagccactgtcatcatttagagtaaaagattatggacttgtatgatttcatagcatcctgcatcaaaaatattttctccaatgttctgaagcatgataggctcaaataagcttccactccacagaattcttaaattgctctcagatgaattctagtgaatatcacaaatatagtatctgaggatctttatattgcaaatcattagtcctgaattgtgattattgaagtaagagtttaaaaaagaatttaaaatgttattctaggaattaattttttactcagagaaatatgatcatcctgcaaggcccagaacattaatgtgaatttttaaccaaggcttcctggtgctttccctgtgttcactgagtagcattgacataggctatgttccttttcacacttgtcaatagcagaagtcatttgtggctcctgaaagcaagaatgtatactctggatatgcttggtttagatacattaaaatcaactaatggcaatttatagggaaaaatagattccttcctacaaagagggtgttttttcataggcaaataaactgtttgaggaatagaaacagtatcaattgcacatctttcttcttttccaattgcgatagttaagattcatgcacaatgattaatacatatgattgtatttaaatagtatgattgtaagaaatatttttataatagtttgtcatttatcaactatctgcttatttgacagatgctaatgtaagtgatagggatgcagaggtaaactcagtggccactaaacttcacagtacagaggaaagaggtgtgtgacaaacacgaaacagaaaatgcacacttcagatatgagggtatggggcaggaggaactggggcagaggcttcagacatcaacatttttattgtaaaaagcacaatatcactttctaactcaggaagcagtactggacagccatctctagagaatagaatacaagatagtctgtgtagaatgtaatcaaagacttcatactctaaagctgttggagaaatatcccagagattgaaaccaaaatgagcttttcatagctccaaaatgtgttagatataatatggtcataagtgccacttatataaacatttgcccctattttatagcttccctaatattcaagccacaaagtttatgccctgatatttactgatctctatgtattgacttttgatcactcaccctggcttgttaattaattttatccttaacatatttatattgtttgggttccagtatttcagtctctacctctagacctgacatgtgcttcattgaatgtgcgtctgatgatcctgtgcatattcttacaaatactgtagtctacggatgtgacatttttggacctttggactatgttaccacctctaggtatctatatcatgtgaataatcaaacatcacaagaaatccagtgataagaactgttgtggcagatcctggaccttattctaacagctttcaattacatattctctttaattttgtgctgttttgtttttgttttttttacagtgaatatttccttcttatccttaaatctgaaaaatgctgacacaaccctctgaggactttactagaggaggaatgtcagaactaatctgcaggtcgtaagtgtgcactttctgttcagtgcttgttacatacccattgcctcaatactgtgggtttagtggacattgaattcacctctgcatctatatcacttatgttagaatctggaaaataagcactcagatatttgctaaataacagaagagtcataaaaccggtttatagaatcatatactattgacattaaatgaactcataaatataaactaattctaacagtgaatttcatagagataaaaatctcaaaaatgtgacaggatttgcacaaggtctcccatttcatttaataatggctgaatcagaaataaaatataaaatacttaaatcttaatttagtgattcctcacaacatattattcgttattttatttgatttaaatacttttttttgacatacaaggtctaaccctgtcactcaggctgaagtgatgtggtatgaatcatagctcactgcaacctcgaattcctgggaaaaagagattctgtgcttcagcctcccgagtacataggattacaggcacgtgccgccatgcctggctaatttttttttctttttttttttttagagatagggtcttgctatgttcccaggatagttgcaaacttctggcatcaagcaattctcccaccttagcctcccaaactgctgggattacaggcaagagccaatgtgcctgactgaataacttttaaagttgaatttcaacaataattatttcactcttagtgcatgcttgctattccttattcatttttacatttttaattcacaaataaaaattatataaatgtatgggttacaatacaatgttttgatacatgtttacactgtggaatgattacataagctaattaacatatattttatgttgtgagacatttgaaattcattctcagcaatttcgaaatgtacaacgcattattactaactagggttatgttgcctgtgcaatagatcttgaaaacgtgtatgtcctgtctaattgaaaccttataccttctgactagcatctcccataagcacaattctactctctagttccaggaattaaagtattttcaaattcaaagtatagatgtgctcattcattatttgcctttctgtgcctagcttgtttcactaagaataaagacctccaggttcattcatttttttgtaaatgacaatttccttctttttgaaggctacataatattccgttgtgtatacatactacgatatctttgttgattcattcattgatagacacttcagttgattccacgtcgctgctattgtgaaaggtgctgcaatgaacatggttgctactccttgtttgtatagctgttaggaaactattttaaatccattatctgtcccttcatatagtgccctaatttgcaaatctgggattaggccctgataatggtgatgttcagtgaatcgcaatcacatgtcttagctccagtatatttttaaagtttaaattttggtgttctgtagaattcctcctcccatattgcatgggagtgcttctttgttagtcagaatgctaccaggatggcaacattatgtaaccaccagatgcatatataatcttcacattgatagcttttaataaactatatagttatctatatttaagtaataataattttatcctacctaggtttgttttataaatattttgataaaataattatatatacatatgcatgcataactatataatttataatgggtaacgtctgtgtggtgaatggcatgacattattccatgtattttaatttcagattagagtagcttatttgaaaacaataactactgaagaattttatatacactgaataagaaaagaaaatgatagggccacaatgatataattcctttttatagaattttgctcctaggtttaaaggagacatatacacatagctttatgtatcctgtgatattaatatggtagttaaatcagcatggcccaggttagtagtgtatcattattcctcagggtaaagtgctctttgtattatcttcttctagctatgtctcaactgaattcatatcaccacatttgctttttatggctctcccttgccttcacatttttcttgtgtgagaagaaatatgaagctgattccgtttgtaaagacactttaataactctcatttatatgtcttactttctctcaaattaatattcataaatcccaaatctaactagtaatagttcatttccattacaatgagcaaaatcctttcatatttgtccttctcacccacaatttttatatcttctttttccctctcactccctgtgtatgcttgtccgtagaaacagagtgtaaattacttcttataggacttcgttttctttctgaaaactcttcttcaaacatttgtctttttcctataaaactttttagttaaaattcatctcattttgtacatgaacataactaaaaaataattgcctaactccagagtactgctttatagctcatctccttccccgagctttttctagttctgtcaggcagtttcatttgttcagtcaaatatagagaaaccaacatttattgatcaacagcagtgttctccatgtacttttgatataagtgtatctgttttacaaagaaaggttaagtaatttgaaacctcagaaaggttaactaatttgtttcaggttcacataatcaataaatttgctatgctgattatggtacatttattgattatgtgaacctgaacaaattacttaataatctgtaatataaagtcgtagtgctacttgtatatctccttttcatgtaaagatctcaggatttttttctgttccaaataatgtaattctccaaccttttttctaaactgctcatactcttaagcatctattcccattaatgaatgcatgtaataaactatgacaactcagacttaccatgcaactccagctatgatctggtcagtgctaagcaaaaatggtttgtttctttcatagtttggaataatatatatctacatgtttgtatgcatgtgtgtgggggtgtgtttaaaattattcttttctttccttgttctactgagttttttaaaaatgcaacttttattttagattcagggtacatgtgcagatttgtttcatgggtgtattgtgcattgctgaggattgtggtacaactgattctatcacccaggtagtgagcataatacacagtaggtagtttttcagcccttgccccttccccctcctcccactctagttgtccccagtgtctattgttcccatctttatgttcatgtggtatacccaatgcttagctcagacttataagtaaggacatgaagtatttattttctgttcctgcattcgttagcttatgacaatggcctccagctccatccatgttactgcaaagcacatgctttcattctttttttatggctgcatagtattccatggtatagatgtacaacattttctttttccaatccacctctgatgggcacctggattgcttcaatatctttgctattgcaaacagcgctatgatgaacatatgattgcatatatttttggtagaacaatttatttttcttggggtgtatacccagtaatggaatgtctgggtcatgtggtagttctgttttaggttctttgagaaatcttcaaactgctttccacaatggctgaactaatttttattcacacaaactctactgaaaatttgaagtggatgttaccaactttgtctaatatattggttatttgtgggcagattgaaaacactgtttggatgaagcttagaggtaactgagtgtcctaggcgatcattaaggcaatttctcctactatttttcttacagaatttatttattaagcacaatagggaatcttctttttaatggtatgttttaatttaagtgctctgtcccaataatttaatttagtattaaccaatctgattcatttattttataatactcattgagaactctgtttctcttctctttaatctagagaaatgaaatcatgaaaataactgtccttatactatcattctcctttaaagattttgaaattcagtctcccttgtaatgtccatctcctggtcttctggagtaacatatctacagaatcaaagtaaaggcagatgcattgatagactgctagctagattaaccaagaaaaaaagaagattcaaataagcacaatcagaaatgataaaagtaacattacatctgatccccagaaacataaaagatcatcaggcactactatgagtatggcacatggacaaactagaatacctagaggaaataaataaattcctggaaagatacaacctcccaagtttgaaccgggaagaaatagaaatcctgaacagaccaatagtgagtagtaaaattaaatctgtaacaaaagatttcctaagaaaaaagacacaggaccagatggattcacagccatatcaggcatcaaaggaacatacttcataataataaaggccatatatgacaaatccacaaccaacatcatagagaatggagaaaagtttaaagtattccctcaaagaactgaacaacacaaagattcccacttttaccattcctattgaacattgcactggaagtgcaagccagagcattcaggcaagagaaagaaataaaagacatccaaatttgaaaagagtaagttaaattatttctgttcactgattatatgattttatacataaaaaccctaaagattcctccaaaagactcctacatctatcacaactttaaaaatacataaacaaatactctttgtagttgcttctctcaggaaatgacattttagtgtgcatctttcagggaagtgcatagagctgctaggtaaatacaccttcagttaactttaggagtatccttgacaagactggctacaatgatgttaagttatataaatttcaagtagttttggactcaatttgttcaaaaagaactaaatatataataacttctaaagaatcttcagagatggaatatgaataataattacatcatagttatatgtctatatacatcatagtaatacatctatatacaatgcatacctttttgtaggaatataagatttaaacaatgcacacagataattacagacaaattcagtaaaaatgcaatctctttaccataaatgtttctaggaaacatttgactcatttactttttctcatgtagatgaaattgtaaaaaattaaaataatttgaaagtttagagcatatgttggtaaaagtctgaaaataacatataaagtacaacaatataaaacctcatgttcattaaaattatttgtcaatatagaggaggagaggatttgtgggaaaacaattttattttagctgagaaggtgtgaatagtttttatgcccatttgatcatagttagctgctacagcttatatgcggcttgtccctcccaaaactcaggttaaaatttgatccccaacgcagcattgttgggaggtagggtctagtgggagctgttttcgtcctggtgtctggtccctcatgaatagattcaggccctcccaaggggttgagtagattctgactctttcaggaatgaattagttcccttaaaagtaggtcatttaaaacagcctggcttcattggtttctctttcttgctttctctctcatcatatgtgccagtgggacatgctcactgtcctttcactttctgataggagctgaagcagtatgaggccatcgccagatggagttgcccagtcttgaactttccagccatctgaattatgaaccaaataaacctcttttctttatacattatgcagcctcagatattatgttatagtaacacaaaattaacagagacatcagccatttttgaaaggatacaaataaaattttatctattatagtaactataaacatattgtagtagaaacacctaaagtataccactttatttattttctaacatcccatattattatcatcaatgttcctcaaactatgcttaagctgtatttttcattaaatgtgttatcctgttttaaccttttatagatagtttaagttataatgatgttctatgattaattttacgatggtagcattttcctataaatgattaacagctagctttgaaagagggctctaatttttaagatttattctataaaaatatatttgactgaggcagggcacggtggctcacgcctgtaatcccagcactttgggagaccaaggcgggcagatcacaaggtcaggagatcgagaccatcctggctaacaaggtgaaaccccgtctctactaaaaatacaaaaaattagccgggcatggtggcgggtccctgtagtcccatctactcgggaggctgaggcaggagaatggcgtgaacccaggaggcggagcttgcagcgagccgagatcgtgccactgcgctccagcctgggtgccagagcgagactccgtctcaaaataatatatatatttgactgaatgttgttctacaaaacttgcaagtaagccattaatttttcttaattgtaaaataagagccagaagagataatagctgctgtttatgtttagaaatgatccaagtgttggaaatgcaaatactgtgggagaagaaaaggaaaatttaaagctttatttgtcaaacttcattatttttgatgggctatgtcagagtcagggttaaagttgatattaaacctccagtggaaccgccagtcataaggaaagcagtgaagttgtttagggagactggattgcaggatgtaactaagtttcaagtgataattccttagctatagtaagtttaattatatcaaaaatgtagcagtaatgtttgaatacttgcctaattggacttattctgttaaataactgatcatatttaaagctcttcttgaaaaagtccctttaaaaatccatcatgccatgtagatcagtgcaaatctacagataaattttcaaaggagttggtagctcccagaaaatctaaaaaatgaaggttttataaatttcttaatataacagaggatatttggccatatataaatggcttatctgtgatattttcatacacttgacatctttggcatatatggtgtaaacacatcagaaagaaaagcctgatattccacagaatcagtgaccataataataagagcagatataggtgacagcaaagagcgtgaagtggaaagcaggataaagtagagaagagacaattaagagaaaaagtctaaattggttgacctcttttttcattatgtttcataaattatattcataaaaaagtcatatataagattgttgaataccataatatggtatgctttattttcaataaagcaaaataaaataaatgggctaaaatatggagatgctacagaaaaatacagggaaacttatatcaaggatagatgtacggtttattgttatataacaaattatcctgaaacttagtggcaaagacaaacatttattatataatattgtctatgggtcagaagtccaatgttgtgtgaatctgcatcaaggtttttgggaggttgcagtcaagctgttggctatggctgcagtctcatctgaagacttgactggtggcagtggtgggtaggatgcttccaaactcattcaaatgattggtcttagtctctggccatgtgcatttctccactgcactacttcccatgccagctggcttcccctagagcaatctgagaaaaagcaagagagacagagaccaaaacatatgccacggttcttttataaacaaatatcagaaggaacaccccattatttcaaatacatttttttagaatcaattcaataagtttagctcatatccaaagagaggtaattaaagaaggatgtgaataccagaacatagagatcataggcagccatcatagaggctgtgtttcatgatagacattattaaatatctctgaatgtgtgatggttaatattatgtatcaacttgattggattgaaggatacctagatagctggtaaagtattgtttctgggtatgtctgcgagggtgttgccataggagattaacacttgagtcagtaaagtgggagaggaagacctagcctcactctgggtaggcaccatccaatcagctgccagtgtggctagaacaaagcaggcagaagaaggtgtgataagctggcttgctgagtcttctggctgtcatctttctcttgtgctggatgctggttacactttaacatcagactctctggtctttggagtcttggacttacatcagtggcttgtgggggacgctcaagactttgaccacacactgaaggctgtgctgacagcttttgtacttttgaggatttggaactcagactgagccactactagcttccttgctcctcagcttgcagatggcctattgtgagactttgctttttaatcatatgagttaagtattcttaataaactccctcactatcagcagaacagcatggggaaaaccacccccgggatccaatcacctgccaccagatcacttcctcaacaggtggggattacaattcaagatgaaatttggatgcggtgcagagccaaaccatatcacaatgtgatcatttagactaagacaaaaatcaaagctagacaaaggaaaataacatgttaatgtggatagcatatgagagaacaataaatgttaaattagaaaaaaaaacagaacacaaagtaaagtcaatctaatgatgtaatgtttggagaacttagcttaaggggagaagaaaattcagagttattctgaaataatcaattaggaataatctcatgtatacttcagtgatcaaggataaagaatttgggcagaacaataatatatatctctaatgaaacaaggtttgaaattggaagacagtgaattagaaactagagtagtacaaagtgaatatgatcaagatttttgtgaggactttgatagatgagaaacttttctttaaaaaagtaagtcaataaaacatggaattagacctggaaaaatgtttgagtgatcatagtctacttcagctatgcactcagtactgatgatgttccaggaatagttttgaatagtttagttcatgcgttaaattagaactttaattcaaaggaatgttattattgaaggtattgctttttttcatcctaacacccattgttaccacagtaaatttaatttatgccaactattaaaagtctaacccttttgctaatgaacagttcaggattgtaaatatggcccatttttggagaatgatttgtgagaagtctactgtaggcatctggaacagacagagagtggtgggaaagacaagatgtctctttttccttggattttgtcatgtttgcagacaattctttagaacggctataagcaccttgttgttagcacaagaatgaagtaaaaaatcaaagatagcaattgttttctaattatcaatgatacaggaatactttcagaatactcatcctaggattaaaatgtctcatgagttctcaattttgtcaaaatccagaatttttatttaatagttattaatttcttttctttttaaaattatttgaatgaagaacactgaatggcatccagatgtataagcagtttttctctttccttataagacagaaaagttatgttacatccctttaacctctaaatagaataaaaaatgcaaagatagacagtaggttggtggtatgaaattaacaacttggcatctgtaacagatatctacttactgtcaaatatttacacagagaaaaacattctttgctgtcaaattttattagagcttgcactgaacaaggaaaaggtctcttaggaatatttcttgtttgatgagaaatgaacacagtgtcattttgctttttctttggggaaagatgaaaataaacacttatttaagtaattgtgagatgtttaaagtttagactttctgcttatcaaaaatgaattgtgggatataacatagcatcaaataacaactgcggctacccaccaatatttccttggtattactacaataggcagaagactgggctgggggaatatcaggcagctaattttgattgcagtgtggtttgggaatgagaataaacagtgtgctttcagagcttccgtggtatagtgttgtgcattgggattcagcacctggaaagtttgaactgtgatctctccaaatactagtggaccctatgtttgttgttctgttggtgattatttacttttggctttctttaaaccattgaatcaaattgctatttgatgtttactgggtaaaaattgttgcaataaatgcatcctaattctaggcatttcacatttttctgttctatatttcacattattttacattatcttgacattatcaacatcattcttatttgacattatctaatagagacactcattattttttacaatgacattgcacatatatacataggacgtggcaaggggagttagaatttaacttcaaatcttttattttcaagaagatatgggttcttgcacataccctctaactaataaggataaatgtcatggtctttaataatattatgccagatatttttatatattacaatattgcaattaattcactctttctactccttcttgaccaaacatactagactgaaaaacaaggtaccaaaacatcgagtttatttctgaagttggccctccaatatctatatacaaatacctagtccaatactttgtcctctagctcagcagtgtgatggaggttccaaagtttgagttagacaggtaactgaagatctactgcacagcatagtgactaactataattaataataattcttgtatacctgaaaattgctaagaaaaatagacctttaatgttctcaccacacatacaaaaatatgtatatgaggtgatatgtgtgttaattagcttgtcttaattatttcacaatgtacacttatataaaaacatcaagttatacaatgtaagtatatacaaattttatttgtcaattatatcttaataaagctgagggggaaacggttatagcaaatattaataaagtgaaattgaaacaaacaaaaaatagtatgacacacaccgcaaatggctgtcttcatccatgttccacaaagctcatgtatcccaaattatagatgtagattattctattgtatgcttttgaattatacctgtctatatggcatctgtggtctatctgcagacatcagttgttgatgactacgcataagcaccttctctaagacacctagactactttttgttgagtaagtagcatgtttggagaaattacctcattccacattccttgaatggcttccttcttctcttcctcctccctcaccctcacagctatcctctcctacagatggcctgtgaccttttcactcctgagaaagttaaaactctaggtgcttcatcagatcacattccacatctttgaccacctttaatcccattttcatcccatttttaccacaccatctctctgttcaccattcaaaatttcaaatcaggctacttctcttctttgtacagcaaacatgccactcttctccaaacctctactcagcaaaactgttctttatattttgatcaccatcagtgtatcacagagtcaatatagattagtagaaagaacttaaacttagattttggaaacagctatgtagcaatcaatgttattatctgtactactaatcatgatcattagcaaaagtctgccatgcagaagtctgttgtcttggtggacatataagatacaaaagaagacaaacatgctaatgtatggtgagtgttcccaactcccttcctctccaaaaggttacacaaatcacagaagccatagcatggaataaaatagtaatattttagtggaaacattaaattgaagctaagggtgaatcgaagaaatgaaagcccactcaccaagataacctcaaagtgtgttgttgggtggcttcagagtttccacaaggcatttatgaatgctctactgagttgaatagtggattcatgtgaaaccacaccaatgactgaggttcttataataagagggaaaatttgacacagagacacaggggaatgccatgtgacaaagaaggcagggattggagttatgcagctacaagccaaagaatgccaaagatagctaccataccacaagtatctggaagaaactaagaaggaccttatcctagaggcttcagagttcagcacagctttgccaacattatgatttcaaacttctagcctccagataaataagggaataaatttctgtagtttaaagctacttggtcattacagcagccctggaaaagtaatatttgttaataataataagtattgtgagtcattatatattaaagagtacacagtgtatgtagagaataggggttaacactctgaaatttaaaaagtaggcttatatctcagaaccaccacttagtactttctcttggagcaagttgtttatccaattcaaatcttaatttcctcatgtaaaatgagaataagaattgtattttcttcatatgattttagcaagaagaaataagataatggacataaataaatgtcacagtgcctggcatattataagagctctatatatgtattcaaaagataatgactctacaagagtgatcccaaagttcaaggtgacacttataaaacaagcatttgatctttctcccccttcacagaaccactagcacatctcacataagcacactgctttaaatactgacacattttcacatggggtcaagccaacagccagcaatgcctagatgtctacaattccctagcaatactccatccgcttgaaaattggaactgacataaaatatcacttatgaatgggcttggaaggtaagtgaaaaacaactttttaaactgtttttcccctgtgcagtaactcgccaccaatgaagtcaagagacttatattttcctgacctgtttgtctatttcatgagcacactgtcttgcaaatagttgatttccattaagttgtcaaacaggcaagaagatctaaggaaaatcagaaagagctcttcagtgaccatcagagctctggctgacacaagtagttgttaacatgcctagtaatcaattggaaattttgtattaaaggaagattattcagctaccatgctcatgagattatgatttattgggtgagaaatctgagattttaacaggtccctcatgtaatgctgttgcaggtggcctgggagttacattttgagaaacactggccatataaatagggagcagcaagagtctgatagttttgttttagtgttcttgatacttatttgagaatataaacacctaaagtcactgagttagtttgcaagtacttggatcaaaattccacataaaaagaccgggcgcggtggctcacgcctgtaatcctagcacttcaggaggccgaggtgggcggatcacgaggtcaggagatcgagcccatcctggctaacacggtgaaaacccgtctctactaaaaatacaaaaaaattagccgggcgtggtggcgggcgcctgtagtcccagctactccggaggctgaggcagaagaatggcgtgaacccgggaggcggagcttgcagtgagccgagatcgcaccactgcactctagcctgggcgacagagagagactccctctcaaaaaaataaaaaaataaaaaaataaaaaaaaaatccacggaaaaatatctaacatcccattctctcgctggtatctcctatccactcaactaggatgtaaggacaaaaagaaaagcccctcaaactgttatctacgtagtaacttagctaaagtataattttgaaaataagccctttgaactcaggtttttacttatagcccccgggcaatctcaggatctgctctagcttctgaagtgctattttaaggatgactctcaaccagtgctgcattagaattctgtgtggaactttaaaaatccacatctgtcaccaactacattgtaatttttggttgcattcacagagcatagggattcctgaattaaatctaatgtgcagacaagattgagaaccactacttgatctgaacagatttatcaaaggctatatgaccaaggtctctgcctgacaataaggaaaaaactgctatttctgaatactctggaactctcagacaagacaaccccaagatgtgtcacagaatatttgtatatatatgagactgtagataatgaggttctcatatattatgtattccaagtctcagaaataagctacttgaaaaaaaaatgtggtctagtacagacgaagtctgagaggaaaaaaaaaaaacactgtaactcacgttaccagcttaacatcccaaaaagaatggaatcttatggagaatatgataaattttaatagaactctagtctgcctgagactacatctctaaaagagtaaagttcacaaatgggaaaattccatacaaaagtcatattccatatgtttaggtttagatacatatgtttaggtttatttttaatagattgattattaatcaatctattaggttaggttgatttttaataaaaaatcaacattacactaatcagtgggacccaggctcataaattatttttgttcataatttttactaaatattgtcatccttagaaagattaaacagttaagcctatcatgattacaaactaccccaatacattctactccaactcacatacatccatgaatatttttccctgagaggatctctatagaacgtaagttaattataaataaactactgtgagtgtaatactttccagataaaaaggatgagatgataatttattttgtccccataaataagattaaacaaggtgtggagcagctgtgtgtcaggcataactattaaaaatctgagccctagtaaactcaatccagtgaaatataataaaaacaagtggttatatttaagaaggtttgaaataaagtgtctttaagtcctttatctattttagaagttgctcttttcacataactttactcttcacctgaaatatgtatatatgtatttattatttttaataaataaggagaaaaaagataaattataaatgtttgcttcatatggcaaaaaagtgaatgcctgaggtgttcatttatttcttttagttataaatgaaaaagagacctagtcacctatttaatttatctcagaaaatactagagctgaatagctgcatagaaacattctgaaaataaaggtcaaaagcaaaattttcaaataaaacctaggtatgtatttcatgtactttaagccaatatatatctacttaaaataataaacctaccaaataataaattatttaggaatactgatacatttttatatggaatgttttggcatagtgaaagattatctttcaatacctctccatatatttgctcaggattatttctgaccgatagtgatgctttgactcatcattgattattttactacaaataacttcctgaaaacctttaatggtcatcatttttggctttatggtaaagagggtacaaaccatgatttcctcatcaacagccttgcatcatgctcgatatacttagattatgagatttttgtcactgggagccacgaagtgtctgtagctatcaggattaaagaacaatcgcaggagcaagtaatcaatctctgataggccagatgtaccaaagaaatacagtctataaaacataatctttgacatctcatttcaaaaaaactgcatgaaagagaaacaatttaccattcattcctaggcaagcagaggtcacagtgttgaggcaccaaaccaaggtctcaaaggacatacttgtcactttgaaaatgttctaagacccctctacaaattgtaaaagctaccaaccatccaggaaaaaaaacgaaacaattttctacaggtgacgaattccataagttacaccaattttctgggcagttatgtctcaaacaaatagtaaatttgacctttttggtgttataagtgctgcaaactctgaaatgaattgatacactttctaaaaaggggatatgttttttatatatcgtaggttctcacttcagacattttagtagtgtctaaaattatggtataggtatattatccctaacaaggtcacagtatttgtcagcttataatggggaaaaccaatcgatgaagtctacctaaataaggattaccttgtgaaatatagttgggtaaattgttaaaaggactaaatgtgattgggttaagtagcttctacaaagtggataatcttcccatatgtcctccgcaaattaccttgagctgatagttttgtgataaaaaatctaaagaaactgctgtattttatatatatataatatatatacgtgtatgtatatatataatgtatatacgtgtatgtatagatatatgtatgtgtatacatatacgtatgtgtgtgtgtgtatatatatatatgttggctctagttgcttctacaaggtgtgtaatcttcccgtatgttctctccaaattaccttgaggtgatagttttgtgataaaaaatctgaagaaactgctgtattttatatatatatatatatatataatatatgtgtatgtatatatgtatgtatgtgtatacatatacgtgtgtgtgtgtgttgtgtgtgtgtgtatatatatatgttggctctactgatataagaaaaataataatttaatcaagtgggcattctgcctattagctgagtggtcatctgttcatttcaggcaataaatagattttgaaactgtatagtaatgaataaattaaaataccattactttcagttttcttttttttcttttatttatttatttatttattattattattatactttaagttttagggtacatgtgcacaatgtgcaggttagttacatatgtatacatgtgccatactggtgcgctgcacccactaactcgtcatctagcattaggtatatctcccaatgctatacctcccccctcccccaaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaagggcatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatacctaggcattaccattcaggacataggcgtgggcaaggacttcatgtctaaaacaccaaaagcaatggcaacaaaagccaaaattgacaaatggggtctaattaaactaaagagcttctgcacagcgaaagaaactaccatcagagttaacagttttctttaaataaaatgacttgagaaaaaaacactaaaaaaagaaaatgttactgaaaattttatagaagatatagaatgccaagtaaattattttaggagataaaatcattatataatagaaatcatgatcatcttaaattttaaatgtatttttattacttaaacaaatcatttacaaccctagccccttatcaagtaatgttttacactttaatttattcatatgatacatgttttattgtcctaatgaaatcacagccatgagaaatctcattgtttattggaggaggcttagaaattcccagatatatgcttgattttatattgtagttagatttgcaaatagcaaattgattaaaaggctggtttacagcctatatacaagcacgcttcattttattgtggttcacagattttcattttttacaaattgaaggtttgtggcaaccccgtgtgagcaactctatcagtgctatttttcgaacagcacgtgctcatttcatgtcattgtgtcacactgtggtagttctcacaatatttcaaactttgatcattgtgattacatgtgttatggttatctgtgatcactgatctttgatgttactattgtaattgttttgggggcatcgcaaaccatatccatataagacagtaaacttaattgataaatattgtgtatgttctcactgctccagggactggctgttcctccttctctcttcttccccatttactgagacataataatattgagactgggccagttaattaccttacagtgacccccaagcattcaagtatctcactttaatttcaaacctagaaataactaagcttagtgaagaatacatatttaaagacaaaataggacaaaatctaggtctcttgtgtcaaatagttagctaacctgtaaatactaaagaagttcttaaaggaaattcaaagtgttactctagtaaacacataaattataagaaagtgaaacagtcatattgctgatatggaagaagtttgaaagatctggatggaagatcaaaccaggtgcaacattcctttaagtcaaagcctcatccagaataaaagccctaattctcttcaattccataaaaactgaaagaggtaaggaagctgcagaagaaaaggttgaagctagtaggggttagttcttgcggcttaaagaaagaaaccatgttcataacatgaaagtgcaaggtgaagcagcaagtgctgatgtggagctgcagcaggttatccagaaaaatctagctaagataattgatgaaggtagatacactaaacaaattttcaatgtagatgaaagaaccttccattgaaagaaattatcatctaggacttatagataagaggagaagtcaatgcttgacttcaaaccttcaaaaaataggctaactcccttgttagaagctaatatagcttgtgactttaagttgaagccagtgttcacttaccattcagaaaatcctagggcccttaaaaactggttaaatctactctgcctgtgctctataaacataacaatgaagcctggatgacaacacatccttccacagcatggtttactgaatactttcagcccactattgagatctacttcacagaaaaaaaaatttttaatattcctgcttactcacaatgttcctagtaactcaagacctctgatgtggatgtacaaagaaggaaatgttattttcatgaatgccaatgcaatatccattctgcagcccataaatcaaggagtaatgtcggtgttcaagatttattactaaaaaatacattttatcagaccatagctgccatagatagtgattcttacaaggaatccgggcaaagtacgttgaaaaccttctggaatcaccattctagatgccattaagaacattcatgatttatgggaagaggtcaaaatgtcaacaccaactggaattaggaagaacttgattccaacttcatgaatgacattgaacagttcaaaacgtcaatggaggaagtaactgcagatgtggtagaaatagcaagggaactagaattagaagcagagctcgaagaggtgacttaattgctgccatcttatataaaacttgaacagatgacgagttgcttctaatggatgaacaaagaaagtagtttcctgagatggaaaatactcttggtgaaggtgctgtgaacatctttaaaattataagaaaggattgagaatattacatgtatttagttgataaagcaatagcagagtttgagaggattgactaattttgaaagaagtcctgttttggttaaaatgctatcaaacagcattgcatgctaccaagaaatattttttgaaaggaagaatcaatcaatgcaggaaactttattttcccttgaatatatgaaattaccacagtcaccccagcttttagcaactacactcatcagtgggcagccatcaacatcaaggtaataccttccaatgacaaaaagattacaaatcgctgaagtctcagatgatcattaacatttttaactataaggtattttctaaattaaagaagctttctagatatatgttgtgacacagttaatagactaaattttagtataagcataatttttatatgcactggggaaaattgtgcgtaacctctttattgcaatattgactttatttggtctggaaccctacacacaatatcttcacagtatactttttcccccaaatattttaccacctaatgaaaatagctacctacagaataaaatgacaattatctaattttcacaatacaaatgaaaaatacaagttctgtggtattggaccatggatatgatgcatgttatttttaaccaatttacttgctaaagaaaacctctctgatgaattatttccctgaggtaaatgtatcattgaaattttcaataatacaatgtcttgcactattaaagagtgaatatctaaaagaaacaaataacatattagtacttattaattatatgagcatatatgcacatacaaactagtttgagtaaaatataaatattttaaaaattcaatcacttagtttgggagagaagtattgaagagggcatctgtattttgcccaatagccaaaacagtttatatagtttatatcccttccattaccagcccttcctcaatggcattcaatattaatagtttcctgtgaattatactaacaattttctaagcattatataagaagcagagcatattgacagcatttatttgttctgtgagagataaaacaatgaaataagatttagaaattctcttattctctttctctctctctctctttttttttttttttttttttttttttttttttttttttgttgaagtggagtctcgctctgttgcctaggctggagtgcagtggcatgatctcggctcactgcaacctctgcctcccaggttgaagccatcctccttcctcagtccccctcgtagctgggattacaggcatgtgccatcatgactagctaatttttgtgtttttagtagagacggggtttcgccatgttgtccaggctggtctcaaactcctgacctcaggtgatccacctgcctcgccctcccaaagtgctgggattacaggcatgagccactgcaccccgccagaagttctctcttaaagatctagcaatcaagcaactttagggaaaattatttacaatgtgtttactatctagaaatactttgtttccttgtcatgtgtacatagtactttttcctgttgttatttacaaatacaaatatgcagatattccacaagaagacagccagagtgtatacgagttaatcagcctagaactgtcctccatttctatttaccctagaagcctcattccattgtttcgactttgaggagattcaagagatcttcgagactttgaaaccacagttatgaaaatattcaaactttctctttttttttgtattcttctctaaaatggatatgataatggcacttacatcatagccatgctgtgagcatagatgaaattatgtatttatttatattttttctttaatttttaagttctgggacacatgtgcaggatgtgcaggtttgttacataggtaaatgtgtgccatggtggtatgctgcacagattaacccatcacccaggtattaagcccagcatccattagatattctccttgatgctctccctccccctaccccactcagcaggcaccagtgtgtattgttcccctccaagtgtctatgtgtctcatagttcagctctcacttatatgtgagatcatgcagtgtttggttgaaattatttatttataatgcttcgccgaattattattttatttggaattaatataaatactgctttgattataaaactacatcctagcatcaaaacaccaaatgatgattatgaaaagtaaaattaaaaaatgttaacatttgacaattgcaataagtgggtttgtgattgaaaactttagattcaaatgtagctagtttaaacaactttacgtatgttagaatacaacgtaaagagcagaccacgtgctgtttgtgtgtgtgtgtgtgtgtgtgcttgtatgtgtgtgtgtgcttgtatgtgtgtgtgtttagtctttatttaggtataatgttggcattccttagagatagtagtaataattcatcattttctcaatgtatattttatgtatgctctaggcattttacttgtaatatctcaaacatatttttacaaaagtttctggtaaatattactaactcaagcttacacatgagggagctgaagcttacccagtttaactgactttttaaatgatacttagaaattagaaagattttattcaaactaagagctatctggttcttaaagacattcattattcaataaacttgaaatcagacaataataacacatttattgtaataaaatgatgttattggagtagagaagcaggcattcttaatataaaatgataataaaaatctttcttaaaagccctaaaactgaatattggtttattttcttaaggtaaaatatttaatgtatattaaatatattaatattttagtataagatatagttcataatgaaattcacattcctacattattatatataaccaacatgaaaactaacatatatttctataaatccattaacaaatattaacatattgatcttaattttatagctatagaatgttagtagtgaatattataatgtcttggagaaaagtttgcagataactgtgatcatcatgattccttaatgttaacatttttccatattagcttcaaatctcattaaaagtaaaagaaaaaaaattagagattcggctaaagtttcagttcttccctatctacactgtgatcactacctcactaaagttaaatgtgtgaagtagatctatgtatgtttagaacaaattaaaatcctgattcaatatttttacacccagatcccttatgaaataccttgcatactacacccatcattatcatcatcaactacagctaaaataaaatgtgcactgtgaatatttccctgaactacgatttccttggcttccttaagtctcagagttaaagtcgctaacttgctaatcaaaactcctatggagatgagagccagctttaacttctacagcccttatggctctaacatgatgattcacaaatctgtctgcataaaagatttttcagaggagtttttaagcaattttgatgcctccccactccattcctataagcagatcagttaaattaggtggtctaattaaatgtgcctgccagaaaactacagcaaataccattcctgatggagaaatttagaagcattcttctaacaattgagaaaagcaaaatgcttactattgccactttgtttaaaaccctaaagttggttctaaccaaagtagtaagaaaagcagtaaagtgtaggaaagaaggaacaaactttaattttcactaaggttaaaaaaaaacttgttcaaaataatatatttttagttggaatgaaaactgacttcttatctcacagattaaaattggatacaataatcaaaatttgtaatgatggacctaaatcaaaagaaaatatattaaattatacatttccacataaggaatgagagaagtgcatactagattctagaaatatgtatgttaagtggcatatataaaggaaaattctcagtctttaatgggataaagcataggattttttaaaacttgtatatgtaacatttgattgacttcctgttgatgccaaacaaattacattatgccatcaatactttaagcgagttgtatctaaaggaacaaaagaatactcctgtaggttctctccaataatattttacatctgagataaaatttcctcggagatttcagatggatatacataggaaggcttgaatttaagctcagcattgacttccagcatcttttctgacttttaaagggcacttacaaaatgaggaagtaaggtctctatgatctgtgatggtttcatatggctttgatacttttggtttttctccagggtaaaaggagaacatagttcggcagcttcatagcaggggcgctttgaggaattactcagcggggccagtaggaattaaagaggagtgacaggcagacctattctcccctctgaaagaatgaatgtaaggaaatgcttttgcctcttctctgctttaaggcatatgaacaaggtctctatagagtttttcagaagcgatatttagttcattttctatttgagttccaagctgtgaacattgggtaaatagtttagtctgtgcttttctttttttaattaataatttgagagctttgcacatattagggtgtagaaatagcatgaagttcctcactcatgatttaacaaaaagaccttttgttttttgctcttctatatgttgcctcctaaatttggattcctgatgcaaagacttcaaagttaatttgctaagtgggacatcacaattaacactgtgaatcatccgtagttatagatgatactgtctacctcaaaaaacagtgtacctggtatctattcaatatcataagcggattaggctctacctcaatttttaaagattacattgaattagataataaattgaaatcatagtcaatagactggtggggctttttcacatatctctgtcttaaagccaaagttttaagtattaaaaatatatttttgtttataagtgttttctcaaaagtgttttgaagtaatgggcaggaatattcccatttaaagtttaaatattatatacagcgcagtagtaatatatatttgaaaatatcagtattgcctaaatataagtgccatgagggcaaatttcttttctgttttgttcccatctatattgtcagagtccagaagagtgcctggttcctaagactgttcatttgatgaatgcctacatctgcattatttaataccgaattcatatgatagtattttattttagcatgaaacaatagcttaaaaataataagaaaagagaagaatctcatctgttattagtaatatatttaagaaatggacttttaagaatatcacatttccagtgttgtgaatagatacagtaagcaattgttttcatctttgagctaaaataaagtttgcttcatatagcctgttagagtttcccattgttaccttttaaagtaatattaaaggagccactttttaaaggattttcccccatagtctcataaagtcggaaaatgtctacttccccacagttttattcttactgttttcaaggagccagaaagggattttgaaaactccttatttaaaaacagatgcaaaacctaattatatttttctttaaggcttcaaaggacaatgaataaaagtaaattttatcactcctggcccccacaaatcactagacatccacataaacatctattaaatgaggaatctcattctttctaataatatgttatatttatatttcaaaaactttccttataatgttttacttaaaatgaataatggatataaaatagattaagattaagaatctgctattcagtgattatacttagttttccatttcattactttacagtccacaaaaaataccattcaaaatagacatgtcttcttgctaattaaaaatatagcaacccaaagatctcttggtacagtcttggcagttagttccataagaagacgaagacattgcaaagtgaattagtatgatgtactgtcgccatagccataaacagtcggtttttatgtttaaccagattatgaggttgagagcattgctgtccacagagtgcatatagtacatgctaagttgactttatttgtaatctagctcaattagatacaaggaaaaccatagcaaccaagctgcagtgatgctgtcagaggaattccctctgatatattttgtcttcccaagttggagttgcagacctcagagaaagtggtttttctctggaccaaaccttatcttcctatatgtaatcatccagggaaaactgaagctaacagctactctcttgaatttattctggcttatattcaaaaactaaactattgccctaaaaagcagttaagcttcacttgatgaaaagcttttggatggttaaaataaacatgtgtttcaaaatattacctccaaaaaaagtaaaacctatttcagaacttctataagtatacattgtatggctttccaaagaaaaggaattttataatacatttttactggatcctttgaatgaatgattattctggatgcatattcttagaacataccctacgtatcctaaaatctaatttagttcagtttggagaatttcctccaggtgacatgaaagagataaataatatctccaattcaagctttatacttaggtaggaagtatcttgaagtaaatatgactaagaacaattcaccttcatatttatatatctcaccaataaaaaatacttctaggtaaaaggaaagagtaatgtataccatatagattccagcagttttatgtgctatcaaacttcattacactatagaaattcattattatttacaatctggaaaggaaatgattttaaaatacaatggtacatataataacaaacatatcactttcagagtatttttcagtcatgattttcttcagctatcagttaataaaattgattgccagtttttcatattcacaaattctaaaaggaaaccacaaacattaaattggttttgttgtgtgataattttatataatttatataagtggataatgtgtaagttgtagtccttattggtgggaaattattttatgtttcagcttaatttattgtttggagataacatatttataaataaaaagaaaatgtaacatggggaatttagttaactcattatgtggactacagtgaggtaatatcatgagatttatgtttttatgtggctcaaaacggtacaactgcacactcaaatcagttttagtacagccgggtatcagagtaacaagaaaacagtgggaaagggtgttccagtaccctttttatgtatttatttttggtaggtagtaatcttatatctataaaattacctttgttagataagtagtttatataggagataaatttagtgcctggggataatttcaaaagaaaaggctatcaatgctaattgcaaagagagacacattaaatcaaataatcacacaaattcactttctactttataataagatttgaaggaaagccaaacttaaagtaacactgacttttccaacttcacttaaaataaaaaatcaaatgaagacaaaaacatagattcatcatgagcagaatactaagataggtgtgtgtgtgtgtgtgtgtgtgtgtgtgtgcacctgtgtgcatgttcctgactttcatcaatagttcttagacatatttaagccctcaggaccagattctcaagagtataaatcttttccatgctgcaaatcagtgttgggacagtgtttaaaatctcccaacagtttcaagagagaaacaggctttaatgagaatatgtgggactacaaagagacacactgaagtgaatagccaaattgtttgaaatgtcttgaaagtaatagttttctcagtgtaatatgaatttaaaataaatatgattctatgtgctctgagaactaaagccaaattcttatttgcatttcaattgagttattttactattttccatttcaatgttttaaaaaatacattaaattgagtcttcaattagatatgaggcttaaaatgaagtatttctcatgtgattttatgtaaaatatcacctctaattctccatttccttcactttctttgccctaatagttttaataattatacatataacattcatttgttaatttagtctcttctctcaaagattatcagtccctgaaagcacaggttttgtttgtttaactcacagctttattcccagcaaccgatacaataaatgaatgaatgatcttgaaaattaaataattaaatgaccaaaaatcaagttgttttggtcattaccactgttagcaacagtggtaaaatgtactaaactagcagatatcctattcctagaaaaatttcatatttgcaagggcttcaagaagggggaagggaaacaaacaagtttgaatgcttgactgtcatgtgaaatcttgatagaggtcatttgaaaaaaaaataaattttacctcagtataatattgccacatcaaaatcatgctgtatgaaacaagtgatattagcattaaaagactataactactccactgggaagaaggcagaggtttagaattttgctagctttggtcacaaacagattaacaggatgaaaacagaatctagtaaaaagcaaataaaaaaagaaaggaacaaaataaataataatttcaaaaaggtcatccccgatacttcatagcggtatagaacaacaagtagtaaacgtagtaatcaatatgaaaataacataattttaagatgatcgcaaactcatctggacaccaaatatgttcatatttgggtaactataagacagacatagagttatttctggaaattgatttttcttctcactattccatacatactgaagcttgacagtagggttctatgagaaaaaactctgagaacacaataaaggccaagttcctacatataggaagaaagagatcttaaggacatgatagggataaataaaatgtgaatacacttttttctcttcctggcttgcaaggatgcacccagttacgctttccttattaaattttcaacagtttagggtatttgagagagatgcttaacttcacctaaacatacccaacaaaataacaaatagacatacacaatctctctcactgtttttctctctctctctcttcccctgccctcaatttaatttaataagaagctattttcagaataaataattcaatgacttacattctttagcattgtttttgtatatcacaaatatagagacagattattacatcaaaagttaatggcagtaggttcaaagatctacggaaatgagacatttaatttatagttaataataggaaaatatttaatcctctaagagcaggagactgatctctttcattttttaaaaacgaattttccaccatccagagaaacacttcttaaattgacttgtaaacttacagagataaaagactttttggcatttctcattaaatgtctaatatctgaattaagagaaatatcaaactcctgtttttagagtttgcaccagaaaacacacctaagaattattagctattttgcaacaacttagttgccttaagaatgatctagttattgttcaggcgcagtggctcatgcctgtaatcccagcactttgggaggccaaggggcgcagatcacttgaggtcaggagtttgagaccagcctggccaacgtggtaaaaccacatctctaccgaaaatacaaaaactaggcgggtgtggtggcacatgtctgtaatcctagctactcgggaggccttggcaggagaatcgcttgaaccccgaaggaggaggttgcagtgagtggagaaggcgccagcctaggcgacagagccagactccgtctcaataaaagaaagaatgatctagctattatttttgccaggtttcctttctctgtcttcagtttaccttggaaaacagattttgaaaggcaataaataggcttttgccatttctgtccacatttctaacataacaggaaactctgtgtatattaaattgtgagttttgtgtgtacacaaacatacaatcttgaataaggatcttttaaatgtctattcttttaaaaattacagatgttctttttattgcatgtgttagtttgggatagcaaagaactaacaaaattccccaaggactattcaagaaaggatgggacagagctcaaccaagagcactacctgtttttgattgaaaggaagcagataactagagttaagcagaaagtcaattagggcaccacttcctttgcacttctggattgaatccaattctgttgaaacatctaaaattgataaatcaaaagtctctgtgtttgttttactctccttggatctttttagagcacctcacatcaacagatccttgcaattgttaatgaagtcacatgaaaatttccatgatgaagagatgccttttgaaaatttacatatttatagtgtttattttgtatagctgtatataaacaaacttgatatagacacaatgtttaagtgaagtttatgagttgagattctaagtgattatatcccgttctcaccctaaattaactgattcatgttcaaattcattataatcaaattttatcattctattgtcaacatcattttaacaatataggaagaaattattataaagaaaatcataaaaatataaaaccaggtcaaaagagtaatgcaaagtatttttaaattaaatgagaataaattataaactattctctattagatataattaagaagaaatgcatttttttgaaaattaataggtgtttcatttgaatattcacaatgcttaccatgcaatgctattaaaaactggtggatttcatatacaagaataaaaggctgacctttcagtcttagtccttccttcagtgagatagttaattataggaaaagaaaataaaactatacatattccagacaaaatgataacttatttccattcaacaatgaaaaacaaataatttctatcttgtacatcttttacaatttccaactagatgtcatattctgctctcccacaatcaaagtttggtattcaagaattccctttaggaacttttgctgatgtctctgactctaaaggctgtccacaatgagtattttttaaatagctttgttgagtcttaattgttatacagtatatttcacacatgtaaagcatacaatttgacaagcttaacgtatgtaaacatgaaacaaccattacaatcaagataaaggacgtatgtatcacccccagaagtttcctcgggctctgttaaaccttttccttctcctgctcttctctgcttttgccattccagacattcactaatctcctttctgtcacaatagtttgggatttctagacttacatatttgtgggctcatagagcatgtactgttatttttgtctgactttattcactcagcctgattatttttagatttatccgtgtggttaggtatatcaatatttcttttccctgaattatgaatattccaatgcactgatgtactacaatttatatatgtatatacacatctagttcttggtggacattttggttttattattttggtgctattacaaatcaaactagtgtgaacattcatgtgtaaatctttgcatacacatatgctttttattttaggtaaatacttaggatggcttggcaggttcatatggtgggcataagtttaatgattttaagaaactgccaagctgatttccaaaaaaattgtgtaattttagtagttttagaaattctaatagatgtgtggtggtatatcattgtggttttaatttgtatttccttaatgatgttcagcacattttcctgttgttgttttttttcagtacacattttggggttaagtgcttgttcattttttcttttttttttttttaagtgggctattttattacttagttttgagtttttgtacatgctaaatgatatatgtcttttacagatgtgttatttggaaaaaactttctcccagactctggtttgacttgaattcttttaattgtattgtgagaatacaattagaaattgttctatctcgttaaatgttccatgaggtgcatttgacacacacaatgtgttattaatgatgtctccactaggccatatatatgagcataacaatattacaggccaaaaccaagttatgtgtaatatgcatcagtgacctggctcattgaagaattgatgactcccaaaatttaagaacctcctatttttactatttagtacagttaattggtagcaaagtaaaactgcagaataatgaaccttgatgtgagaaagacctttgtgcattattagttctcttaatcatgtataactttgtgtactttcctcacatgcatagaaggggaaatactgttttatggattgttagggggactgaatagtatagtctctgagtaagtaattagcacattctaggtgcttccttattatcaatagcataatgacaaggaaattaaaaattcaacctttccccaaacacgcgcacagaacagaatacttcatataagaaaataaaggtcagaaagatgtaaattgttaagtattttgaatagctaattgtgaagatatatatatatatatatgatctatatatacaaaattaggatagtacagaggctctttaattctctctgcatatgaaaaagaagcctgataaatccacacatgaaaaagtcttcttggtctatactatgactacttgagaaccctcaagaactccacaaattctgagatgatactttatctataataatgtaggtcataaaaatgtttctaatacatttgagaggcagatatgagggacaacaaggtttttaatatattaaatatattgaattaatcattcttacattctttaaagagaatgtgatataaataatcacttttttattgtgcgaataaccctaaaatctcaaacaccatttataaatgagagggcaaagtacttccttaccaaatatcacagcacccatagtatcttgaaataaaattagagacacattagccattgagaaaaagtcacataattgtacctttttatttattaaatgataaagtggaaaaatacagaaatattgggctttgcacactgtttagattgagataatacatttcttagataaatgtgccctatattcccatattgcacatacagagatcaactgtgtctttggcttttgaagtgagaagatcactttaatgaacttagatgatatgataggtgactatgaatccttaataaataacttcaaaataaaataatgttccccatcatcacatgagcgtggataaagatgtagctgtaatggctttgcataaataagtgtaaaagaggaaagctgatacaactctaaacatacatgtttaagaagtatgattaagtccctgggattccaaaaatattctaacattataagatacatcaatgagtttaatgtccattttggcaagcaaaaacaaagcaaaaagataaatgtaaataaaatataaaatgtaataaaaaatataactgtgccgtagtgcttaagtctacagatggcaatttctacttaacacatactatgtgagatttttgctggttattatgagaatggggaaaacattagagaagagaaaggctttgaggtcccatgtgctgcccagcttatttcttttaggctccatgtttgaccttcacagatcctcatgaaggtaaggacagaataacaaaacacaagagatcattagctaggtagagtataacacatcacttgggataccatttgtctttatccatcaaaaatatttattatttttcagcttcctacagaatatgtagtggtaggcctggcacatgtcatcatccaaactgagtataattttcttgactttggtacttgcaaccatctacataaaatatattgcaactcatctagacctaaagttgtcctctttctctgaaaaactacagctgctgtaattcagtcttcaataaaacacataaactcatgcttaattgtacatatacataatataaagatattgcatcacactcaaaaggatgagcaagtcaaggaaagaagggggtcatgttgagaaaaataatatcagaaaagggaacattatctcatgttggaaatgagtggtccttttgacaccgatgcaccataggaaatagaggacatggttgagaaatacattatcaatgttctaaacaaaattcaaaaggcaactgaaaattaggagttttttcatgtcttttgggtgccagaccatcatgtctattctattcagataattagacagtctggaaaagattggaatatctttagaggaaatgctgagagaaaaaataggcaaattctatcttctaacatacattatcctaatatgtgagtcagtagccttgtgagcaaggccactgtattgggagagcattttctggccttcagacctactttagcgcaaaagcaacataggattcagatctagcgatctctcctgagattattacagtttctatgtctgatcaatagtgagaggatggtgaataaaagtgtggtctcttcttctagcctacaacatttgtgagaagaaaacttagatagaaaagtgatatattcagagagaggtgttttggtatgtaagataggtaaatgccaaaggcagagtatggtctcttgccttcacatgcctttgagaattctgaaagcctcatcaaagtaaactttgtagtttattattgtcaaaaagaggggcactctgaattctaagctttattagcagtcattagttcttacgtgttatacacatcatcttagcagagaatttagctaataagtggaccaaaacaggtatttgtagcaaggacaggtggttttgaagaaggctgtagaatatgcctcatttttttttacagccagcaggattcaaattcagacttcatcacagtgcaaagtgctggtcactactgtgccctaatcaaggtcacaaatcatgtagagactctgacttcagatgtaaaggtctgggggaacaaggaatgtcatatcaaagaataaaggaggcagagggcatagttcttaacacatttttatttatatgatcatgaggactttctgagttatacaatacctgacacttcttgttcctcaccccacatacatacacccccagacgctactttagtgagagaatttggaggaaacattggcaacaccaaaagactgagcatttttttcattcaaaagagaccaaataatgcacagctcgatcaattatataattggatttatttatttctcctccctagctaacaagaatatggaggcttctgttgtaggctggattagttacagtttaagtaaaataaattttactttctcagtagatcaaatatttaattttgtcaataaattagtgtgatctaactgtaagaataatgtgaagtcatttccttgaagacaaggaaaaatattttaaaattaaaagctatcaaaaaaagcagtgaataacaggtaaaagaagaaacacagtatctagtaaagtaaaaaaatgcaaaaaaaattctcacaaatcaaaagaaaagagtaaagagtaaccaataattaaacaaaaaacattgagatgcatggagaatttatctggaatattctgtcaccaaattagggaaattaatgaaaaaaagagtgattataaaccaataattaaacaaacaacattgagatgcatggaggattgatctggaatattccatcactgaattagagagattaattgaaaaaaataaatgagaatggaaataataataatttttcttttttttttttttttaagatggagtttcactcttgtcacccaagctggagtgcaatggatcttggctcactgcagcctctgccccccaggttcaagcaattctcttgcctcagctttctgagtagctgagtttacaagtacctgccaccacacctatttctaaaagatatttttcctcaatttaaaggaaatcacatattaaaaatttcatttccaggcaaacttaatgagaaatgtaatataatacatctcctcctggacttttcaaacattcatgacaaggaaatatagaagattgagaaggaaaatcatccaaagatattggaattagattgacacttaaactatctacactattagacactggggtatattaggtggccctcagcttgaaaagtttcagcttaaaattcttattccagcaaatatgttacatgtgttcatagtaaataggaattttgaaatacacaaaaaaggaaatttttaaaaaattctaaaaattacactaaaaaccaaaaatgataattaatacccagatttaaaaaaatatgaaatatgtattataatgcactgaaaatgagaaatttaaccataaatgtttatgtgattaccattgattgaatatactatttattaagcatttgctaagtgccatttagctaaatattttaactaaaataatatatttaatctgtaaattatttgtgtgaggtaagtcctcaccccaactattatctccatattctcactgatgatttaatgatggtaataaagtaaattgtccttgagcagaataacttgcttggttagtgtgtatgtgtttcgggtgtgggggtgcatttccatgagaaagcatataaatattgtttaaaaattaaaacaataaaattttaatctgagattaaattaaattaacaaatactgaaaaagagttgggtatgtaaacattctctattcctcattttacaaaataaagagtaataatttcccagattacataaaatataataattcatacttatgacagataaaactgttatagaatttctgaattatttacacgacagctctaaacaagtgatggaattaaagcttgttcttcacaggttcttagaatgtgactatagggagaagaaaatcagttattaaattctagatgagttacattgtggataggtcaaacatttctctcactgtagccttgcttgtctaatcatctgatcactggaaaagcagcgtttatacagtctgtaatctgtttgcttgctgtttataataatatacatattataatacattatcaattaatttcttgaaacttttgctaagcaggtacatatgacatgatcattttacttatttgaattcagaagtgtttttgttttgtgtctcttgtcccatagaaacatagcccatctcaccagaaacttgtcatctagctggagagacaacactaatacaatgtattgtcaatggacaacaaagtgcattcataaagcaatatattgttcagtgcaattagaagacaaggggtttataatctgtggttacttatagagtatacatgatgagggtaaaacacacttcaggttagcaaggctatataatgtttagggaagaatttagcagtcatgcttgaagaaagccttaagtgatagcataggtagagaggcatacagaaattattttatgaaccacctaagccaaaacaaaagtaatgtgggctagccagacttagaaatagaggatacagcacaggaaagaagagatacaaaattaagaggttattcagattgacctgaaagttgaactccaaattggaaacattttgtagttcaaatatcagttatttgactgtctatacctgtaacaagcacaatgttgaaagtgacttttatttctgtattaaaaattcagttattcctatggccaaccagaaagaaaccaaaggtcataaagaaataaaaatggcatgtgaatgaaggaagtctgtttattatagagcattacaaaaatagaagagagagaattagccaaagcaggcaccttctgcttccttaatgtcctttgggcctgtatataagtagtgaatgttaaatattctaaaacactctggaagcctgccttaccagcactgattaaaagaactgaataccaaatgtaaccaacagatttccttttcatttatctgctactgagaatactaaatattttcttatctccatcactcttagaagttctcttgcaacgtgcctatctatacatattcatcactctgacagcagaatcaagaataaaaattcagataagaaagcatgatgttcattcttttatcttttaaatatgggacacacataaaaatagatatttgaagacagcttcttagaatgaacaataaaaataactacagtgtatcctcattttaccctgttaagagtagaacaatggcacataccaatcatttggattgtggctactcataattcctcttcccctaaaagtcaaccgtgaagggcccatctataagaaatcctagatttactgcctcagggattatacttctacagatcattcctagcctactaccactcaggcagtaggaaggatgatctaaacactcaggttgaagactttggaagtcatagcaattcttgagctgaatgtctgggtgaggcttcattgtactatactcagacaaatacctcaaagacaagagataagtttaatatttgaaaaacttatttcatcattactgtatttttacactttctgttctctgaataacagcttagagaagaggattttgccccctttgcactgttgtctcatttgtcagaggccagaaagattcttttagtaatttaactatatgatgccaactaataatacgcctaaaagaggcaagaaatttcctctgcaaaacattgttttgtttaatttgggatatttttattgcaatttgtctttctgttttggttactgatattttgggaaccaaagaaacaatagttcttattattttgaggtatatatcactaaaaagaacaagctgaatcagtcaaggttttttttagccatacacgttagtctacttttcttttaaaatttatttggctattggtgatactataactgaaaaatagctaagggtatctaagggtattttttttttgagatggagtctcactctgttgcccaggctagagtgcagtggcactatctcggctcaccacaacctccgcctcccgggttcaagcgatcctcctgcctcatcctcccgagtacccaggactagaggtgcgtgtcaccacagccagctaatttttgtatttttaatagagacagggtttcactatgttggccaggctggtctcgaactcctgaccttgtgatccacccacctttgcctcccaaagtgctgggattgcaagggttagccaccacgcccaggagtacttttaaagaaacaaagtaggtaaacataaatgcaaatcagttattttttatttaactttcaattttattttactatagtcaattagaaacatgcattgaaagtataatcataaagcattcacatctaattttgcctccttcaaaaactagagtagaaacagctgagatacacgagtttgaaaagattccaaattctatccagctgttgacttttctgaaagttctggtgagaatataagaatgaaaacatgactgaaataaggaactacaatgcttctttcttgatttattccctagattaaggtgcaactgaatttcccagcggaaaaaaaaaaaatagcttagctccatgaactagatttttacttgtaatatgaatgccaagtcatgccaataagatgtttttttaaaaaatgtttcttctccttaagttttcctaaaatccagggccttgaagattgacatttacttttcagattttaatatttctgcactttcttccttccttttagcaaccactcaggcagaacaacattggttacaagagtctcttcaaagagaaaagagccacaaataagtgaattggcatatccaaatgctttcgttgttaaatgcaatattttcccctaataatatacaaagtaaaaaaaacaatgtttctaatattaaaatctcaggtaataagttaattcaatttaatattaggtgcttttatgtgactccaataagcaattacatattgagaataaagagccatacacatatattttaaaaagaactctttcagggtcttactataacccaaattcagattttaggttttatgtttttccaaatattgattacttcatactttcccatggtcttgctcctgtggctgttggatttggataaatgtttctacatgagttacattctgtgtatgaattgctgcatgacagttgccacataatacgttggcaagaaagtctttgttggatggcaaataaattaagcaaaacaaacatttgcattctgcttcaaacaattaatactgtacttgaataaaccagcaaatagtggacatctctatacaagtgggttttcaataaagggaaagaacaatcacaacgtaattgcaacatatcgatgatagttgtaacttgaattcaaaaatcaacactctacttatgattctcttttgagatacagctcttagtttgtaaaccgttgacatgaaattttaaacatatacttgaatattaaataaaacataacataccttatttgcaggtctttggaatggtatttcgaaacatgacaatgcaaattcctgtaaataaaaagaacttattcagtcaaaggcattttctaatttgaattgaaacaacaattatgtattatttaaaagaaaactatttgttaactactaagtatttctttataacttctggtgtttacatattttgtagcttgttttatatgttcttacagccagaaacaaatgtaatatatgtgtgtaccattagaaatgtgctaattctacttaaattttgtattcacaaaatgttttatctttaagtgcttttagattcagatattagatcattttggaaactaatttttcaaatttcacaagcaatatggaaataatgcataaggcatattgtgtttggatttgatatgctagatattttacctaaaactgagcaataaatataactgaatatatttgatgattacacctgggtattaaaacagcttatgaaaaaatccttctttctgtataatatagtttggatatcccctccaaatctcatgttgagacgtaatctccagtgttagaggtggggcctgatgggaggtatttgagtcatgagggcagatccctcatggcctggtgctgtcctggtgactgtgagttctcacgatgtctggttgtttaaaagtgtgtgaggcctcctcagaagcagatgctggcacaatgcttcctgtacagactgcagaaccatgagccaattaaacctcttttcttaaaaattagccagtctcaggtatttctttatagcaatgcaagaacaacctaacacatagtacatatatttaatatgttcatttatttaaaaatggaagaatgatatatttcacactgtaatattttgaagaatatcataataaagttttggataaaataatacaataataaactagggttattttcatatcttgaaaaaactataatttattatgttggctttgagacaagatatctaagttaatatttaagagaagataattaaggaatattccaggatgataatcacactatattttatttatatttcccagatttttcagcaactctttctctcaataagataaagatataatccattgtatcatttttctagccaataaatacctagttaagtacttactggaatactgaattttctatccaataaatacctagttcagtattgttctaatgagtatttatttactccctggaatgaggcagactcctatgaaagcactttcctttttaaaatgtagtcccaaggaaaacagtacaagaaacattttgaatcctgaatatatagataacatgtagcatgaaagattctagttctaaccatagtttcagtatatcatgtccatttaaaaaatacaaaactggtaaattaaaagagtagatgtatatttgttaatgctaagtgttttactacaaaagcgaaatcatatatggtacaataagagacaaaggtacaaaatcatagaaggggaaggaaacttggagatcatggagactgaactccatttttctgcaagatagagtcttgcttaagtcatgcagcacattcataacaagcctggaattggaagctatcataaaagtaacgattgccatttaaaaaaagtattattacacgaaaagaaattcagctgtatgaagttcctgtaaataattcacttgctggacgtagagtatttatttgtggaaattagatgaatataaagtggatctaagttatatcctaatacatgaagatgatgcaaataactgatgctgaaatagtttatccttaaggtattttttagttctttaatttttatcttaatatttcaaattttattatttatcacaaggatacaaaagcaaatatctatttaaatggtgctagctttctttttcagctgtttctaagagtgagaaaataaatttataaagtttataaattatcacaggaatggttttatttttacttcatgatcatgattaaagataattcccctcccctcccctcccctccccttcccttccgtaattttcttttctgttttttgagacggagtctcaccctgtggcccaggctggagtgcaaaggtgcgatcttggctcactgtaacccccgcctcccgggttcaagcaattctcctgcctcagcctcccaggtagctgggactacaggtgcccaccaccaggcctggctaattttttgtatttttagtagagatgggtttcaccgtattagctaggatggtctcgaacttctgacgttgtgatccgtccacctcggcctcccaaagtgctaggattataagcatgagccaccgtgcccgaccaaagattatatctttctatttgtattactcttataactttctaacaaaggaatgacatatttttcaaatatgtatttcagtagaaaataatttttagagttgcttaaaatttgctgtgcattccaataataaagtgctttaaaaaaaaagacatttaatcaaagcctccctaaaatgtttctcaattgtaacaattagtattctttatctgcctatgcaattaactgtaagaaaaaaaattaaaacatatacacccacaaaagattgactgtgttgttgtcactaattgtttaaatattttacttacttatttaaggcatgttcaaacttattgatcactatataccaggtgtatctgccatcttcctagacaactggaatatatcagtaaacacatttttaaaagtcttttacttcggcacttacttggcagcaatacccaggaaataaacaatgtgcaacacaaataaaacaagtaaattatatataatattcgaacgtgataattttaaggggaaaattgtcagtgtaaaaaaaagaaggttgtgagtaaggtggctgaaacttataatatttaataaacagggcagattgaaggagatttgagcaaagtcttaaataatccttgttgattttatctaaagtttaggataaagtttgttagtatttagttaaggtggtaactgaataaatgataaaagttaaacttgtttgcatttcaaaaggaagaaattaatttcaatccattacttttacaaataaaaattgcattctacagatttattcaggaatgcctttgacattaaaagcattgctatgatttggttttttaacacaaacatcaccaagatatattccaatttgcttaaacaaaaagtttatatatgacaatgtataaatggcaacaataccttgttctagatatgaatttcactactgaataggagcatagtgtggaaattaaccttcagcgacccagtttatgtctcagtttcaatgtagtaaacttgtcacaaaatgtttcagtttcagaataagcaagccaagctaccaaaaagctctcccctttatcttgtaattagagtattatgatagtattggtcaacaggcaatgttcagattgctttaggaattaattattaaaagatgcagcactagattttcacatttagggtatcatttgtgctctagaccttgtgataacaataaccaagtgaatattaaaatagaacaaagcagccaggtgtggtggctcgtgcctgcaatcccaacattttggaaggccgaggcaggtgtatcacttgagctcagaagttaaacagcctgggcaacaaagtaagacccccctccaccatctctacaaaaaattagcctggtgtggtggcgtctgtatgccagatactcaggagcctgaggtggaaggatcacttgagcctgggaagtggaggttgcagtgagctgaatgatagagtgagaccctgtctcaaaaataaataaatgaataaaataaaataggacaaagctagtgcattaaggttacagttttctggaactgcttaattggtacaattttattgcagaacctcatcaaccagtgtcaagtctctatgaaatatatgtaatattgctttcgaatgtagattttggtgtttataagacacagataattttatcatctggtggcaatatacatgctaataatgtgatttattcatgaatttgccttatattttagcaactgacatacacacatatatttatttcatgaccacattattttagagatttactcctaccttaaataaatgtcatttttttctaacatgtagtcaatgtaatttacctggcacctacacagatagtctcatgtagtccttacatgactcatattataatccattacttctatagaaaaacctcactgaaaatgacttgataatgcttgtgaatatatagttaagatccctattgcctcttttaataaatcagtttgagcaaataaaagtgaaatatttgtagtcatttatttcaaaagttctaggaataaatcctatacaatgtatttgggagataacctaattattatggaatgcattaatttcttctcatcagaaaatcataattttataactgtgcatctgaaggtcttctatatatatatttattaagcaaatttaccaaatattcatattgatacattccattcaaatgatttttttttgcaatgttacaggacccgttcttccaaaagctcatgaaatcacagcttcaaattcaccagtagtttaatgtaactgaaacaagcaaacaaacaaatgactgtctcatttatattcaaagaatgaattttattttatatcttgatattaagttgttggacttaatcaataagctctatacctactttcatatattatcatgtcagataaaaaacaaatgtggatgcacgtgtcactatcctatttgaaagagctgatacaccactgatactgtttggttttgtgtccccacccaaatctcatgttgagttgtaatcctcaatgctgggggaggaggctggtgggagatgattggattatggggtcagatttctcccttgtcattctcgtgataatgatttctcaggagatctggttgttggaaagtgtgtagcacatccccctttggtccctctctcttctgtcaccatattaagagatgcttgcttccccttgccattctgccatgactgtaagtttcctgaggcttcctcagccatgctttctgtacagcctgtggaactgtgagtcaattaaacctcttctctttataaattacccagtttcgggtagttctttatagcagtgtgcaaacagactaatataacaacaaaccagaagatatgtcatttctgggcgaaatatcagtgcccttactgaggatgtatatttgctctctcccccaaatggttgtaatctgctctagataaataaattcatggaatgtttgtaccttggttgcatcttctcattagctatttatttcagtcatttgagagggagggaaagagcatgggctttaaagacagccatagataggcagttttgtgctgcaatttcagcagtcactgtacttgggcaagctgcttcatctcctcgggttacaggtttttctttcctaattagggggattatcatcacaatgtatataatatggaacctagcctgtttaacaagtaatggcttttatccttgatttttcaaattagactttgttctttaggtggccaaatatatatgagtattttcattgcccttcctttactcaaatgcagaaaagagtgtccttcataaagatgacggttggaggtatgaaggaggaaacagactaggtacgaaagaaaagaagggataccaagccaataacatcaacactacagtgttcgtttggatgggaagtggctacatcactaaacaattgaatatatggcttttttgaacatacaatttcaaattttattatattctatgtgtttaaaatagtcttagcaaagcattactcattacctttaaagtaagttgaagctatcatttaattcacaggttaagaaagtataccaaattcattttgaagaccattcagacttccaaagtataatagctaagaatatgatgatcactttgttccccattagaatgttcccctgtataggtcacatataatattgtaactacaaaaacaaaatgaaatctgaaaaataaaatagaaataagaaactaaacctattttttgccatgttttttttttgggaaaaagtattttatgaagcattaaagagcagtaagtataattaaactgtaatccagtattagaaacaatctaataatagtccaattcaaaaataaaaattattgtaggtatgaccatgaaatttcctgacacctgatttaatgcattgtgctaattttctaaaacaactcagaggaaccaaatcattttttccacaaacacactattctgtatgtcttcattttattgcagtgtttcaatagttatttaaatggtagagttcatttgtcaagtgaatatgaagagcgtagttccctcccacaacaataaaactacaggctgccaagtcaagatgtataattggtaatgctgagccatttattctgagtgcactctagacaatgacatattattactattatggcacaaataactgcctttttgaagcaaatgttttcactggctttagttaggatgctgtcctattccttttaacataatactgatgccctcagtattattttatatatgtcaatgaaacaatatcatgctgtgaaatttatgataaaagcaaaactaaaaatcattggttgatttttgtttccccctctcttccttttaacttcagctttgcaaaatcactatgtattctgctgtggaagtataattaatgttattttcttcttattactatattttaactttgcatcttaagcctaaattttagcctattcatgtaaggttgtactttaaacaatacctccaatagattttcatactccatctaactatacaaagagaagagactatctagttacaatttatgtatttgattgtggtagcttatgcctaccctaaatattttccctcctaggtcaacctggtttgggttcaattatatgatgattaaaaaaaaaatctcaggttggaacaaaatctatataataagatgacaaaatactttcataactatttcagttatagcttctactaagttgcatttacaatgatatatttacataacagcataatggatagaaatataaagagagagaccttttgtctctctgtgccatcagaatgaaccatgacatttaggtgccttgaggaaagactagaaataaactaccaatcaggcaaatgaacaaacaaaaacagaataatttctttcctagctgccccacactttatcacatcacttcagtatgccccacttccttaactctaatcaatttccatgtgccatttgaggtaccacagctcactctcagaaggtcaagaggtaaagtgtggagaaaagggaagaaggtgggtataaattaaaaaaaacaaaaaggacaaagataaaatacaagataaattaaaattatatttttaaattagcttttgttccttgagcatctgctatgtatcaggcattctctattacctattttcgttctggccacacaactacactatgaagcagatatgactgtaccactttcaaattcatataagaaaaccaatgttcagagaagttgtctgaggtcccacacctaataaataaatgacagagcaaggatttggcctcaaagtccagattctttcctcagttgcacagtgccacattataaatgtgttgatacactgaaatagaagaataatatcaaaagtatttctttttattttctctcaacagggattaataataataattatgtcagaacttgggcacaggctttaatccttaaaattcttttaatcattattttatcatcataagcacatacaagcaacactgtatttatttcgctgaaatgtataaaatcctggcatagccaatgaatttgtttgataaattatgagataaattcagctaatggagtttccaagcatgctgtcaaagaaatagaatcatgcatttatgaatttttccatatttttcttcatttctaatgcaactagttaattatttgatctctttatcactttaaaagctttgtaatagttcagatgatgtgagattatttgcaaacaagataagaaatgccagttcctgggacagttataggaagcctgagaaggtaaggcttttcaaggaaactaggtcgtgaaagagaatattgctataatccttagaaagctggatagagttgtcttttccaatattaatatgaggctcaatagttccatatggacaagaacaggggttgagatctctgagtcatgcagaactcttctgtcaaaacagaacagttgcagatgtgtcatgaatacaaaaatttctccctcttaacatttccttttcaataggataagccacttttaatgcagcagattaaccgatttactttctaaatatgctcagatttactttctaaatatactcagattaagttaaattggttaatctcatttggccttacatctggtaacaatgtacaattcaaaggtttacataaagggaactctttagtaaagacaaaggaggaaaaggcaaaatctttctctcaccctaaggtcagagtgagcttccttcaggcattaaactgctgaagaactgcatctaagcaacaagggagataaatcaaaaggggctggttcagaaatttcctaggtagaaaagaatccaacatccaatttgtaaattgatacttccagaatattatccacatcattgaaagtctgcacaagaatcattagcagtggaggacccagatgactattctctctgaatattctctttcaaatacaacagtctttaaaatacaactcagaaatcgattagattatttttttattttctttctactttaatttaaattgcaacaatttaaatatattttcaatccagaactgttaataattttaccaagctcacattaaaataaaaaataaattccaaaataaatgcattcatatgtacatacaatttgatgattttaaattttattttgttctctctatgtttaatttcataatttaaactccaggatttatttgaggattgtttgaaataatgtaggcagaacaattagctcagtgctaggctcttaactaattgccaggggtaatattcctccaacatctccgtgtcagtttgcttgagaaataacctggaggagagagagtgcccaacattttgcaaattcaaaaggtaagagaggttcatttataaaggtacatcctagtatataagacagcaagtacataggaatccatgactgtatgttgaatattgttatcagatatgctaagaaatgtttaaaatcccaccatcagtgtctccctaggaatttctgttttctcataagattattaggtcttaacatgcaggcatcatgttaacatgcagaaatcacattaccctaataattgctgtctcctcagatcctggcacactgtctggaaaacaggaagtatccagtaaaagtgagtttaattacaatatattggccacaaacctaatggatccatgttttctgctttttgtatgtgcaccatcactctgcattttcttttcttggcagaagtcacagagaaaaggaaagagatgattcctttccatgagtgtatattggtaggtcattgatgactcagctataattcaaatgtatatatttctctggggaaaacaggttgtaattactaaacaagaaagcaaaattaatgacactaataaatatatgacacactaaatatattccaggtatgcttctaacagactaactgaaaaatatctgatttttacccaatataattatgcatgtatttcttcttttttatattctccaaaatgtattgagaagaaactgaatcagaaaacaacccttcctctggatacactataaatcccccctgcaagcactacagcatttttactgttgacaattatttcttccacaatgcagtgtcatgtgatgaagacgtcacatactgaacttagtatttatccagtctttagctgtgttttcactgtatgctctcttggtctctgccctttgattcacgtgaatcctcattattgttctggttgttgctattgtcattgttaaggccccctgggaacactcattcctataaatacaatgttctccaaaaaaatatgaaatttatcctctttgctccccaaattgtcccttaaatagtttatgtctgtaagcacaataataaaccaatgaggtatatgtgtgatattgcaatattgtgatctagggataattattttctgtactgcaacccttttaaattcctaatgatataattgaaaataattttaagaaatttgtatagatacaccataccctatgaaagctggtctttctcaataaaagactggacaaccctaaggtaggcctaagaagtcaagaaccctggcccctctttctgaagaagtatgctgttacattgctgggatattcagacagaatattctgctgggagaaacccaatccagaacttttcagaaacacacaggctacagagacattgttatgggatcctcagggtgtcacttcaccagctggaaacctctgtggccagtggtgcctttgcctgagttttgctctggcccactgggctggttctgataactcagcctggcaggctgtgctcaactctgctacatgcttggatcccatgcctgccgagggtgagcctggcccagagtggcaaggggtgtatgagtgggcatggggttcagttatagtgcatagccaggcacactggctgcggcatggcaggcaactccaggtgctggcacagtcaccagctccctgagagactgtggttggacaaggcgtaccataaccagcttctacaggtgatagtggggtttgcagtgtggtgccagaaacttggagacaccaggaactgcagagccctaaataggctgtcacagccctggcctggggagcttctaggtctggggccccacaaggccacagctcttacctcctctcatccctcctttttgtcacctgcaacatggcaggcaacaggcaagtttccgcccatatcgtgttacagttacagctcttttagctctaacatttgccttgtccagagttcttgtcctgcatccaggaagaaagaggtgtgcagacaagtggagctttattgagcagtagaacagctcagaggagacccgcagtgggcaaatcatttctgtaaacggtgtcctggagagtgttcagctctcagcagagagggtagctcttctccattaggtcatcccaatgggtgttcagctctcagcagagagggtagctcctttccgttaggcaggtcatcccaatatgtgttcagctctcaggggagagggtagctcctccctgttaggcaggtcatcccgatgaatgctcagctctcagcagagagggtagctccttgttgcagctggtcatcctgtcatctcttcagctctcagcagaaagggtaacttctctctgctaggcaggtcatcccgacgagtgtccagctttcagcagagagggtagtttctctctgcagctggttgttccatcatctccttgagcctggctgagcccagggcttttgtgggcttccaaaaggagaaaatgtgtgctgattggtctatgtgctgtcatgggtgggcccagaaaaggcaccacgagttctcactccagtctgcgggacacaaagcccagtccccaggcttcaggccttccctggcttgaaggtggggcttcaccaagaccccatcttcctctgagaagcctgatagcctcctgcctctgttcatggagcccaggttattaatgccaaggggtgcctgcaggccagtgcagagctttccttagcccctgtctcagcctccctcccaggcttgtttgcacccaaagtctcgaggaggccaaggtagcatggggctggtgtatcagcactgcctcgagcatgtgcacccctggacaggttgtgacaacacctaggactggcctcatctttgctccctgattgagcaggcccaactgtggggagaagccagacagtgtgagcagtcacttctgagcctgcggtgacagggaggcattcctgggccctcagagtgcaaagattccctggcccatagctgcagcttgggcagctgcagctgtgcctaggagggtggggctcctgcctgctcccagctcccagagcacaggggtgtctgggtcacagcagctgcttgggcagctgcagttgctcctggggagcagacactggctctgtggagcgcagcaccacctcggacctgctccacttgggggcccttctctgctccagcctttatgctggaacaaactgctccctgatgatcaggtgactcagccaggcccctcacgatggctcccagggaggtggtctccaggggggtctcaggggaaggctctggggactgtccttctcttctccccgttttcctggtggtgccttcagctgggtgctttcaggctaccaaaatacagcggggagcaaagttgaggccatggcaaagaccccaggcctgggagaagtcctgcccatctgtgcgagggtggaggtggcatagttagctgcttcagggatgtgggacacaggggtcccactgccaccactgctgctcccacagttgctcctgctgccatcactgacacctccccactgcagctggctggatggcagcacctgctccagatagcctgtggcggccatcaataccaccaataccttcttctgtcatcaaggtacaatctcccctgcaccaagtggggagagttatatattcctgagcaaaaaactccattcactcttcatttactcaagttctgaaggtaaagataaaccggaattacaagcatatttttttccttatatttgagtgtctatgttatctgtttaatggactgctttgtttaaaaagagatattttcttagtctcaccacagaaaataacaaataacattttgattagattaagatagatgtcatcattggaaatctaggcctaaccctgaggattgagaatggtatatgatccacttcctttctgtgcacaatatattaatccccatcagatcacctaactacaatgaaaatttgcctgactaccccttcattttaccaaaattctattgataatacctactccaacattttcaactgatttttatcctttgtatgcagaataaggtatgcaaaacaataggtttttgttaaattttcattcagaaaatcagtgaactattaactatttgttgaataaataaataaatgaacaaacaagtaacaaaccagtatcagcagagattggatccaatattgtatctcaataaaatgggactgcatcatgtggtcagggttcaccagacttcacagtgcagaggcaattgagatgggacagtggaaaccataattattacagggtgaatcagcgtagtaaaaataaaggaaacaaagacatgttggagatgagattagtgctcaggtatcagggaaagatggttgacaagaatggaatgaaaatagtttcataatctggaaaggatgaagtgaaatatccgccctagtacctaatttttaagactttgagtttcactcttagtttttctggcagccatattctgaggcagataacacaggtcttcagatgcagatcacacaggtcttcagatacagtttcaccggttaagctcagatttcatagaaggagttcatttcttactaggattactttgcaggggaagagacatatttaacaaatctaaacctccattagccttgtatcaattggtacaaatttttgttataagttttagaaatcctaaaattatactgatttaaggaaattaattggtggatataaatgaaaagtttagacatgcttagatatacaggttcaaagaatgataacagacataagacaataaactatttttaataatctatatgatgggtataaaatacaataaatgaatgataaaaagagcacagtacctagagaaacacacactcaactttactctttttaactttttgccaaatgttttcagattttgctctgttaggcattgatatgatttggctttgagtccctacctaaatctcatattgaattgtaatccccaggtgtcaagggagggaccaggtggaaagtgactggatcttggggtcggtttcttccatgctgttctcctgatagtgagagagctctcatgagatctggttggttgataagtgtctggcagtttcccttgcactctgtctctcttgccaccttgttacgatgtgccttgtttcccttcaccttctgtcatgattataagtttcctgaggcctcccagccatgcagaactgtgagtcaattaaacctcttttcttcataaataacccagtctcaagtagtatctttatagcagtgtagaaaagaactaatacaaacatccattggtctttaactgtagcaaaccacattcatcattattattatttctattggtgtagatatggagaaatgacatgatttatgaatagtaggtttgaataacattaactttcttacatttttattctagacttgttgattctgttttgtgtgtcataatacagtgagtaccattccatagtagacaaattttgaatattttcatatatatatttataaataaatgctaattcagttaagtttaataagtatttaccagtaatatgaaattaaaaattttatatggctttaggaagatactagatatagtttggctccttgttcctacccaaatctcatgttaaattgtaatttccagtgttggagggccttggtgcaaggtgactgggtcatggagcagatttgcccttgctgttctcatgacagtgaatgagttcttataccagctgcttgtttaaagggtggcaacttcccctgctctctcctgctccacgaggtgaagatatgcctgcttccacttttgccttccaccatgattgtaagtttcttaagacctcaccatctatgctacctgcacagcctgcaaaattatgagccatttaatcctcttttcttcataaattatccagtggggactcaggaagttcattatagcaatgtgagaacagactagtccagaaattggtaccagagaagtagtacatcactataaggatacctgaaaatatgaaagtgactttggaattgggtaatgggcaaggttgaaacagtttggagggctcagaaaaagacagaaagatgagggaaagtttggaacttcctagagaattgttaaattgttgtgaccaaaatgctgaatggaatatgaaaaatgaagtctcagctgagggggtctcaaatgtaaatgaggaacttactgggaactggagtaaaagtctctcttaccaggcttagaaaagagactgttggcattgtgcctctgctcaagatgtgacctggctgcttctgaaagcctacactcatctgcataaacaaagaaatgacctgaaattggaacttatatgtaaaaagaaagcagagcataaaagttgaaaaatttaccgcctagccatgtgatagaaaagaaaaacccattttctggggatgaaccctttaagctagctgcagaaatttacataagtaaagaggagcctaatggtagtagccaagacaatggggaaaatgcctcaaaagcttttcagagaacttgtggcagcccctcccatcacaggccctgaggtttaagagaaaaccatggttttgtgggccaggcccatgacccttctcctctgggcagcctcacgacatagcaccctgcatcgcagccactccaggtccagccatcagaaggtgcaagccccaagcattggcagcttccatatgtgtgcagagggcaagacttgagtcttgggagcctctgcccaaatttcacaggatgtatgaaaacacctggatgtccaggcagaagaatgtggaaggggcagagccctcatggagaacctctactagggtagtgcaaaggggaaatatgtggttggagccacacacagagttcacattggtgcactgcttggtgaagctgtgagaagagggccatagtcctaaagattccagaatggtagatccgtcaacatcttgcaccaagtgcttggaaaagccgcaggcactcaatgtccacctgtgaaaccagctgtgggtgatctaccctgcagagccacaaggacagagctgcccaattccttgggagcccaccccttgcatcagtgtgtcctggatatgagagatagagtcaaaaaatattattttggagctttgagatttaatgacttccctgctgggttttgcatggggcctgtagcccctttgttttagccaatttctcacttttgaaatgggaacatttacccagtgcctgtacccccactgtatcttagaactaactatcttgtttttgattatacaggctcacaggcagtagggggttgccttgtctcatatgagactttagactgtgaacttttgagtttgtgccaaaaggctttaagattttcagggactgtttgaaaggcataattgtgttttgaaatgtgagaagggtgtgagattttagagaggccagggacagcatgatatgatttggctctgttttcccattcaaatctcatgttgaatttcaattctcagtgtttgaggaggggcatggtgggaagtgattggatcgggagggcagatttctctttgttgttctcatgatagggagtgagttatcatgagatttcattgtttaaaagggtgtggcaccttcctgtttgctctctctttttcctgctccagtgatgtagaatgtgtcagtttccccttcaccttctgcaatgattgtaagttttgcaatgatgggccagtttgaaattatttatgtcaaaatgacataaataaaaattgttttaatccctatttcagtcagtcatggtaaaacttcatctgagattttcctaattgttacatacaatcaagatcaaagttactggttttccatggaaactcaaaacatatggaatagggggccttatgctggaaactttaatcttgcgccttagttttccactctggacactaagcaatgtattaaacctcctctcaaatcctcattcctttgaaaaatgacaataactgagcccacttcataggttcatgctgaaaacagcattagataatctacataaggcttctactaagaaattcatagaatactcagcttttcctaaattagttgggataaccaaaacccttcaaatctcagtggtgtgtggctacaaagatttgcttgacattcatattatttgctcacagatggtaagtgtcgtcctcactcaaggacatgccattatccttatctgggacatgccattctcatggcagagcagaaaaagcaaagatacaatcttatgatgggttacttctttgtggcatatgccactttttaccctgtatcactggtgaaacctagacatttagacatacgatacaggtctaatcatcaaattatacaaaacaaaacagtcatagtatctaccgcaatgatcaattacttattatcattgttattgctaagaagcactatgtacataaaagaacgatcaagatgtttaccattctggaactcatggaatatatggaataaattagagtgctgtcatgaactttgtgtctaagatctgatgatatgtgtgccacatgctacttgaaggttgaccagtacaatctctacaacagaagattgaacccactacaaagcttcattttttagtcaagatattaagtaagtgaatatcagatattaatgatgctaatatgccttagaaaaaaatcctcaaaattatttggaatataggagtccatgagatagaagagggctttcatagctatgaatgttacatgaaactctgaagtgttctcctggggatgaagaaataatgcactctttgattattcatgctctacatataaaattagaattcataacatgtaaaatagaggcctctggaaaaatttccatcttgataggggtgactgataggtgtgcacagtagctagggtttacataaagtgttagtactgaaataatatacagaacatgtgtaatttgaataagttttgaaaatcaagtatatttcaaggacaggccacttccaaattgagcaggaaaccttcctccttaagctgaagttttctgtattaagaatatttcattcccattctgtaagattctaaataattattcaaagtacaagaatttgtatccattaaatatcttgagattacctatttatttatttattttgagatggagtctcactctgttgtccaggctggagtgcagtggcatgatcttggctcactgcaacctccacctcctgggttcaagcgattctcctgcctcagcctcccaagtagctcagctcacaggcacctgcaaccgtgcctggctaatttttgtatttttagtagggatgggtttcaccattttggtcaggctggtctcgaactcctgaccacccacctcagcctcccaaagtgctgggattacaggcaagtagctcagcttacgggcacctgcaaccatgcctggctaatttttctatttttagtagggatgggtttcaccatattggtcaggctggtctcgaactcctgaccacccacctcagcctcccaaagtgctgggattacaggcatgagccatcacacctggctgacattacctaattttatttacctgaaaatatttgttgtctccccaaggtgcatatataggaagtcactacagagttttgacactatcagctttctctttttagtgaaacttaaatgtgttaggtgactagagcaaaaggagagctctagttcatatgtattatatggatatggcataatatcattcctcatctggtatctgtctgaatagccacatctatcaaatctattgtttgctctaagtataaaaccagcttaatggggtgatttgtttaaaacaaaacatttttaaagtttctattttttaaagctgtgtattatgagcagaaaaatcattttccatcctatggcatatatttcagaagaactttcttatattctaaggagcaaaagccatcattacacatctcacaatccgatatcaccttttatatctatctccccacctccaaagatgtaattgatttttaaactccatttataaaaattaagctggtattttccaaattgtaagattaaaattggtaatatttgacttgaatacagagtgccatgaccgctgattcttgctatttctagcaacagggaaaggggaggatttttgggattttttgcaagtgatgagaatggtagatggcttgcatcttggtatgtagtgcttactgtcacataggagagtcccagcagaaagatgaccatgtatgcaggacataatacacagaaaacaagaaagagtacgggtagagtgagctcttttttcatcaggaaattagaaatttagaagacatgctgcagatggaagagtgttgaatagcattggttagaaacaatgcctatggtactggacaagagtaatatattagttggaccataaatacgtaaaatgcatttggctagaacatatgtattgtataatcaaagacttagatttgtgtggtgggtaatattttctgtgtttagtagacatgaaatttatcaatttagaagatttagccaatagcctttttgtcagaaaaataagaagagccctagaggagactctatatccctaaaaccagataacttaattgtgcaaagaacgtagctgatgtctgaacaaacaggcaaacatttctgctaagaacagaatagtgaggacatcctgtcattgctagatgacttcaataagggactccttccttaccaccagtattgtgaagatgacaataaaccatattcaaatacagtacatcataatacaacattgaactcatttattgcctgtgctatgattaccatccctgtactttgcacgtctaacttaagcccatatagagcatacaactcaagtgaaacagcttctgggaaggctagaaactatgctctgtgacttgaatactcaatgcaaccaagcctgcctctaaagaacaagggcatcaaaacctgatgtgaagaatgaagactagaggtggtctccagaaatttttagataatttaaattcaagttccttttggataccataaaaatggggaaggttctctgtgaatgtaactgaatctgtgtttccttgacaaatttgtgcactaaggcatattcaaatggtttaaaaaataaaagaaggagatatatttttactcatatatgttggtggaggatatcaatactaattatctcagtacacatttctatgaggtcagttacatatgtatgactttttttgtaaactgatatttaaaatttctctcacttacgatagtgattttctccctgattttattcaaagcttttctccctctccatactttaagtttctcatgaattccttatttatgttaaacacatcataacccaaacaatagctatgcaaaatgcatttttttcttgcttttctagcttgttaaggcctttattttgagaaattatgaccatacgcttctattaattttgcttcaacttttccagccttttcaactacctttgattggaggatgatgaaattacattactctgaaattaaacagaaaaatcagatatgacaagtcccttcttggataggttgtattatatgaagaacaagaagttatagaaaaaaaaatgagcatagtcaaattataggatttgttttttggtttcttaaaaagcaccttataacggagagtaattctcatttaaaaaaatactgttccgtggaattatagaatgttaaatagactaaactagaatatctgggccaacactctcatttaagagatgagataactttgtctcagaaaaaggagcagtgcctttgtgaaacacatggctaatttgtggcagcactaacatgaaaacttcagtttcctgattacacactgtcattaatatggtaattgcactaacaccagcatgagccatattaaacatatgcttctaattgcatgtagctacactgtttccttatatcccaatattactcttttttaataaaaagtcaaaacaaataaaaatacttgtatgtgtaagtctatagaaagtatatattgttctccttagcagtcaccttttcaaatacagatgctcctcaacttatgatgggtttatgtccatataaacctaatttaagttaaaaatatcttaagtgaaaaatgtatttaatatgctgaatacaccaaacatcataagtgagcctaacataccttaaacatgagcagaacatttggattagactggctgggtgggagctgcaacttgccagagtatcatattgcgtatcactcatttaggaaaagatcacaattcaaaaatttaagtgtagtttatattaaatgctgttgctttctcaccatcgtaaagtaaaaaaattgtaagttggactatgataagttggagactgtctgcataattgtttcagtgttaatcgtttgttgtcttttacacattcatgttccttgaatactctttttttggattccattcctgaacttattagcttcaatgtataaatcagacatgtgatattatttaagcatcccttgtgtagtcatagtttccctacaatatatgatttctgttctcattttataggtaggaacattatatagggcaagatcaacaactatccttgagcctcatctaaccagcaaaagggataatgtttgctcaatctctattagcctgaaagaatttcacccacgttttgtacttgatttactttcagctgttctttaggaacaatttcaagccatagtgcctttaagatacttcctctgaaccccaaaatataaagccacacatataatatctctctatgcatcccagagtaactcacatgtatctcctttgcttcggatacattacccttactgtacagttctctatttaatttttggtgtttttctgtttctgttttgttttgatttatagtaaatactaaacaaatgcttgctgaatggcttggccataactttgactttagactgcaggacttgtctacatttctcctcttgcattgtcctccaaccataggtaacccaacagatttgagtttaaacattactttcatatgaaatatgaactacgattttcttccagaaaaccaagcaacattgcaaatcttatacaaccttcccatttgaggataccactgaaatgctcataaattctatgaggtttgggaaaaaaaaaaggctctgtaacatttgagaattcattctgcttcttgtcatcactgggactattttcacctttgtctttcctaagtggaactgtagccctcattcttcagaagcataacaagggggacatgtatttattcttccatctaatacatgattaataatgatctatactcctctcgttttgagttgaataatttacgtatccatactttttaatattctctatgttcgttccaatttttaaaccattcattacttcagaaagacgcgacaatgaaaaacaaaaatttctcggccgggagcggtggctcacgcctgtaatcccagcactttgggaggccgaggcgggcagatcactaggtcaggagatcgagaccatcgtggctaacacggtgaaaccccgtctctactaaaattgcaaaaaattagccgggcatggtggcgggcacctgtagtcccagctactcgggagatgaggcaggataatggcttgaacccgggaggcggagcttgcagtgagccgagatcgcgccactgcactccagcctggacgacagagcaagactgtgtctcaaaaaaaaaaaaaaaaaaaaaaaaaaatctccagtgtgtgtatatattaggcgatcaggacatgtgtgactgtggcattcctaagaagcattttatacaaattagcatgagccttagtcttctcaaagtaattattccctgaatacttttatttttcaaccatagaaaccaatttattgaacccgcagaatacacaaagccttcactaacaagtgtgaattgagaattgtgaatttctactttggaaacaagtttgatgaataagaatcatagagtaaacacagtgtttctatcatcttttagtaattatgcagttgtaccagaatggaatatacacaactattttccaaacaagaggcagttgaaaactgccaaaagatttgaggcttcatcttggctttgtaaatgtaatgatgaattattttgatatagtaacccacagtctattgactgatgaccatcatatcattaggaataataaaaaagtgccttaaaatcatactgcctgccaatgaagccccattcttctcatgagtgggtctgtggcatttcctcttctgttatgatcctcatttcatgtgcatgtattataaactttattagaactgatggtacaaatgatgccctctttcacacttctaagatgtggtaaaagactcttatccataacctagaagagttaaattcttgcatcttaccaatctcaattttccatgctatttagagttgaatttttcaacattatatagaggcttgtccaaatttcatactttttgcttaactttatctttgcttcctgattctattgcctcaatatataccctcacgaacttttattatttttatttttatttatttttttttactttttaacttttaagttcaggggtacatgtgaaggtttgttgtatagataaactcatgtcccaagggtttgttgtacagattattttgtcactcaggtattaagcctagtagacattagttatttttttctggtgctctccctcctcctttcctcctttctctggtaggaccaagtgtctgttgttcccctctatgtgtccatgtgttctcaacatttagttcccacttataagtgagaacatatagtatttgtttgtctgttactgccctagtttgctaaagataatcacctctagctccatccatgttctgataaaagacttgatctcactctttttatggctgcatagtattccataatgtttatgtaccacatttttttcattcagtctaacactgtattagtccactctagaactggcataaaaaaactacctctgactgggtaatttctaaagaaaatagttttagttgatgcaaagttccgcaggctgtacaggtagcatctctggggaggcctcgggaaacttacaaccattgcagaaggcaaaagggaggcaagcacctctcctgctccatggtggagcagaagagaaagggagtgaagagggaagtgcaaaacactttcaaacaatcagatcttgtgaaaactcactcactatcatgagatgagcaagaagaaaatcctaacccatgattcaattgcctcccagcaggctccgcctccaacacacaggtattacaattcaacatgagatttgggtgggaaaacagagccaaacaatatcattccaccttggtccttcccaagtctcatgtccttctcatttttaaatcatgaccatgccttttcaacagtcccccaaagtcttgactcattacagcattaagtcaaaagtccaagcccaaaatctgatcagaggcaaggcaaatcccttccacttatgggcctgtaaaattcaaaacaagttagctatttccaagttaaaatgtgggtacaggcattgggtaaatgctcctattccaaaagagagaaattggccaaaacaagggagctataggccctatgcaattccaaacccagccgggcagtcattaaatctcaaagcttaaagtattttacaggctcatatgtggaaaggagttgccttgtctcagataagattttggacttggacttttgagttaatgctggaaagaattaagactttgggggattattgggaagacatgattgtgttttataatgtgagaaggacataagatttggaaggggccaggggtggaatgatatgttcgactctgtgtccctacccaaatctcatgttgaattataatacccacaatcttctttgacaccacaatcttctttctcacatccaggccacaatgatgtaagggtgagctcccaaggccttgggaagctccacctctgtgactctgcagggcacagccctcatggttgctttcatgggattaagtgtctatgcctttttcaggtgcatagtgcaaactgttgatggatcaaacattttggggtttttaggacagtgggacacttctcacagcttcactagggagtgcccctgtggggactctgtgtgggcgctccaaccccatatttcctctctgcactgccctagtagaggttccatgaggactccacccctgccacagacttctgcctagacactcaagtatttccatacatcctctgaaatctaggaagaggctctcaggctttaaatcctgctctccacatgcctgcaggcccaaccacgtggaagctgcccaggcttgaggattgtaccctctgaagcaacagcccaggctgtattttggccccttttagccatggctggagctggattggctgtgatgctgggtgccatatccagaggcagtgcagagcaaagggtccctgggtctagcccatgaaaccaatttttttctccaaggcctccaggcctgtattgggtgggactggcatgaagtctctgaaacaccattgaaacattttccctattgtttggctattaacttttggctccactttgtttatgcaaatttatgcagcaggcttgaatttctctccagtaaatggggttttcttttctaccacatggacagtctgcaaattttccaaacttttatgatctttttcccttttaaatacgaattccaatttcatgaccatttccttgtgagtacatgtgagcttatgctcttagaagcagccaggtcacaatttgaacactttgctgcttagaaatttctgccatcagataccctagattatctctctcaagttcaaagttccacaaatccctaaagcaaagctacaatgccaccagtcactttgctaaagaatagcaacagtgacctttaaccagttcctaaaaagtttatcatctgaggcctcagtctggactttactgtccacataactatcagtattttgtgtgcaacaatttaaaatgtctctagaagttcaacaatgtccttcatcttacagtcttctgagccctccaaacgattccaacctctcaccattacccagttcaaaagatgcttccacattttcaggtatctttataacaaagccccacttctctggtactaattttctgtattagtacattgtcacatagctaaaaagaactatctgagactggtcctttatataaaaaaagagagtgaaatttaactcacatatctacaagctgttcaggtgacatggctgtggaggccataggaaacttaaaatcatggcagaaagtcaagaggaagcaagcactgttctcacatggtgaagcaggaagtgggggggaagtactacacactttcaaacaaccagacctcatgagaacttacaatcacaagaacagcaggggggaaatccgcccccatgatccaatcacctcctcctaggctctccttccacaacgctgaggactacaattcaacatgagatttgggtagggcccagaaccaaaccatatcaactactaatgggcatttaggtagattccacatctttgctattgtgcatactacagaactaaatatacacatgcatgtgtctttatgactggacaattcatatgcatttgggtatatgcccagtaatgtgattgctgggttgaatagtagttctgttattaggtctttgaggaataaccatatttttttccacaatgaatgaaaaaatttacactccccccatagcatataagtgttcttttttctccacaacctcattagcatctgttatttttttttaccttttaaaaatagccattctgattggtgtaagatggtatcccattatagttttgatttgcattttcctagtgatcagtgatgttgagctttttaaaatataattgttggctgcatatgtgtcttcttttaaaaagtgtctgttcatgtcctttgctcaagttttatggtgttgtttatatttttcttgtacatttgtttaatttccttaatttgctagatattagacctttttcaagtgcatagcttgtaaaaatgttctcctattatgtaggttacctgtttactatgttgatcgtttattttgctgtgcagaagctatctagtctactaagattgcatttgtcaatttttgcttttgttgcaatttcttttggcatcttcatcatgaactattttcccatttatatgtcctgcatggtattgccaaggttgtcttctaggcttttttatagttttgggttctatatttaagtttttaatccatcttgatttgttatttgtatggtgtaaggaaggagtccaggtttattcttctgcatatggctagccatttatcacagcatcatttattaaataaaaaatcctttccttgttacttgcttttgttgactttgctgaagagtagattgtagtaggtgtgtggccacatttctgggttctcgattctgttccattggtttatgtatctgtttctgtaccatcaccatgctgttttggttactgtagccttgttgtatatattaaagttaggtagtataatgcctccaaatttttctttttgcttagcatttccttggctattcaggcgtttttttttgttttcacattaattttaaaatagttcattatagttctttgaggaatgtcattggtatttccataggaatagcattgcatttacaaattgctttggcagtgtgaccatcttaaccatattgattcttctatccattagcatgcgatgtttttccatttgtttgtgtcatctgggaattctttgagcagtgttttgtagttcttcttgcagagatctttcacctccctggttagctgtattcctagatatttcattctttttgtggcagttgtgaatgggattgcattcatgatttggcacttggcttggcttctgatgatgtatagacatgttagtgatttttgtatgtttattttgtatcctgagtttttgctgaagttgtttattagcttaagaaacttttgagctgagactatgctatggggttttctaaatataggagcgtgtcttctgcaaacagggatagtttgatttcttctttttctatttggatgtgtttatttgtttgttgtgcctatttggtcttgccagtacttccaatactgtgtgtaataggagtagtgaaagaaggcatccttgtcttgtgccagttttcaaagagaatgctttcagtctttgcctattcagtatgatgttggctgtgggtttctcatagatggctcttattattttgaggtatgtttcttcaatacctaatttcttgagagttttaacctgaaggaatgttgaatttcatccaaaggcatttctgcatctattgagataatcatgtggcttttttcattagttatttttatgtaatgacttacatgtattgatttgagtatgttgaactaaccttgaattccaaggttaaagcctacttgatcatggtggataagctttttgatgtgctgctggatttggtctgccagtattttgctgtggagttttttaaatcagtgttcataataaatattggcctgaagtttttttgttgttgttgttgtactctgcctggtttttgtatgaggatgatgtgggcttcattggatgaattgggcaggagtctctcctctttaagttttgtaacagtttaggtagaaattgtaccagagcttttatgtacatttggtagaaatcagctttgaatctggctggtgctgggctttttttttagatttgtaggctatttataactgattcaatttagagccattagtggtctgttcagggattaaatttcttcctggttcagtcttgcgagggtatatgtgttcaaaaatctatccattccttctagattttctagtttatgtgcacagatgtgttaataatattctccgatggttatctgtaattctttgaggtctctggtaatatcccattgttgtttctaattgcatttatttggatctgtttacttttttattattctagatagtagtatatctactttattaaatttacaagaaaataacaactcctggatttgttgagattttttaaaatttttttttaatctatctcagagtccttcagttcagttccaattttggtaatttcttgtccttagctttgcagtttgattttagttcttttcgtcatgatgttaggtagttaaaatgagatctttccaactttttgatgtgagcatttagtactataaatttccctcttaacactgccttagctgtgtcctggagattctggtgtgttgtatacttgttctgattggttttaaagaacttcttgatttctgactttattatttacccagaagtcacttagaatcaggttattgcatttccacgttattgtatggttttcaggaaatatctttgtcttgatttctaacttgattgtgctgtggtgcaagatagtggttgttatgattttaggtgttttacctttgcttaggagtattttgtgtccaattatgcaatcaattttatagtgtgtgacatgttttaataagaaaaatgtatattttgttgcttttgggtgtgaagtaatgtggatttctatcagattcatttgatctaatgctgagttcaggtcctgaatatctttattaattttctgccttgatgatctgtctaaaactgttaatgaagtgtggaaatcttctactattattgtgtgagagtctaagtctctttgaagttctctaagaacatgctttatgaatcttagtgctcctgtattgggtacatatatatttaggatagttaggtcttcttgctgaattaaaacctttaccattaagtaatgcccttttttgtcttatttgatttttattggtttaaagtctgtttcatctgaaatttaggattgaaaccttatctgttttctgttttccatttgcttggtagatattttttcatccatttactttgagcctgtgggtatcactgcataagagatgggtctcttgaacacagcataccaataggtattggttctttatctagcttgccactctgtgccttttaattggtgaacttagcccatatacattcaaggttaatattgttacgtgtcggtgtgattctgtcactgtgatattagctggatattatgtagacttgtttatgtggttgctttataatgtcaccagtctgtgtacttaagtgtgttcttgtagtggcttgtaacaatattttctttccatatataatgcttccttcaggagctcttgtaaggcaggtctggtggtaacaaagtctctcagcatttgcttgttcaaaaatatcttatttctccttcacttatgaagcttagtttggctgaataaaagattctggaatgaaatttcttttcatttagaatgttgaatattggaccccaatctcttctgactttaaagtttctgctgagaggtctgctattaattagtctgatgagcttccctttgtggtgacctgacctttctctctagctgccattaacatttctttctttcatttcaaccttggagaatctgataattatgtgtcctgaaaatgatcttttgtgaagtattttactggggttctcagcattttctgaatttaaatgttggcctttccaacctgattgaagatgttctcatagatgatatgctgaactatgttttccaagttgcttccattttctccatctctttcagggacaccaatgagtcatagatttggtctctacataattccatatttcttggcggtttcgttcattccttttcattactttttctttagtcttttctgactaacttatttcagaaagctgatctcttcaagctctcaccttggtctattctgctactaatatttgtgattgtattataaaattcttgtagtgtgtttttctactctaccaggttgattatgttcctttctgtactggctattttgtctgtcagcacctgtatcattgtattgtgattcataactttattggattgagtttcaacatactcctgcacctcaaagagctttgttgctatccatattgtaaattctacttctgcaatttcagcaatctcagctcacttcagaatccttgatggaaaggtgatgtggttgtctggaggaaagaatgtactctagctttttgagttgttagagttattgcattggttctttctcatctttgtgggctgatgctaattcaatctttgatgttgctcaccattgaaagttttatttttccttttatcctatttgatgaccatgagcgtttgattgtggcataagccaattgaatggctttctttctggatgatttcatgggaccaatgttcagctcctaactcctagactgtgtgctctaactctgggggacttgtattgggccccaactttgtcatctgcctactcaatgtaaggagtccactgtgctagggtctgaggtgctccttgactcctggtcactacacttcaatgggtggtgtcagacaaatcatgctgcagtggcagcatggtggggtgcacgatcatcagctgtggcagggtgctggatacttttattcttatatgcaatttttttgtttcctgatgttggagagattttggtatagacattactattaatcatatagtcactttggagatcattatggtactcatataccaaactaccttagatcttccataatttatcataccttctgaccgttgtgacaacggaaaattgtggcccattggccaaatttggtaagcagacatgtgttacttgtaccctttacaactgacagaaaataattaggaagttgccaatagtttaaaaggaaatttcacaaacaagtctgagtgtgtggcttttctggaaaatattagaaaatgtgttgtcagtgaatctgcaactatctcacatagcaacaatcagctggagctgtgtgaggaattcacagttctcaacagttttactttctaacatgtggcttgctcagctcatttgtttctaatatctggtctgctgtaccattttaacatatgagttaaaaataaattatttaagcagatagataggataaggaagtcttccgtgaagtttactttttaatgagaagtagtccccaaatcatttgttttctaactaagagcagcctgtaaaattgagctgcagacatagataagcaagctggagcacaggtgaatgctggcagctgtgccaatagtaaaagtctacctgggggctaggcatgttcaacatgacatctccatctttccttttccttgccaaccacgtgtacagtaaggagcacacaacgtggagccaaccaagtaaaaaatccatttgcataataaaagattagggtggggttgcaaggttcttcactcactgtgtaaatgtcctgcctggtacaaccaatctttgagacctatgtaaatcagacaccacctcctcaagccagtctataaaaccccaagtgcttcactgtaggaccggaagtcccactcaagtgcccctctctttcgcaggagacagagctattctcttccctctttcttttacctgttaaacctccactcctaaacccacttattgtgtgtttgcatccttgacttccttggggcaagacaatgaacctcaggtatttaccccagacaacgatgctgcttcaatttgtttactctgttttcctttacttgaatttttgatttcaacacttgtgtgactagcttggtcaaggtaaccttggctctctcatttggtttaaatgtccttttaatgactctgtaccttatttattcttatagaaataataaaccttgaaattattatattatataatgtttacatattaacatgatactaactttcctatcaatactctaagatttctgaggtcctagctcatgttcctctttgcattccaaataactgtaaagtgtaggaattcagttaatagttcttgtttgattgaacaaagagatctaataacatgaaaaatttaataagacatacgtaatcaattacatacgtacttactaatagagtaacaaaacatttgggcaatttttgtctcttatgaataatttacaatgtatttccatcagaattatgaattagcatgattgatggcatgattgatggattatatatttacttaatctcctttggagctacattccatttttcctggagtattttactttcaaactatactttaggaccattttatcaaataacaacttcatgtttatttcagatacataaaattatatcaaaaccacatttctgagcatttgaaaactggcatgaagagtgacagtgatgagctatattatcctctgggttttatcattctgatacattcctgcttgtcattttgcaagtgttttctggaatatattctgttaaacagaaacatatcatttatttcaaataaatcattgtgtgacttttcagtaacgtttgaaacatctactaaaactcaaatatgaagttaacctctatattccaaagcaaatgtcatagaatgatgtcagatttccaggatattctcatacacagggagagtttcctactccacactagtgggcaaccagtgaattctgcttgtgctgaggtataagcccatttaattccctggagcagatggataccttggtgtataggcagatttgtccacttaatatagtgtgccttacaaacaatatcttttctatgtgttccaaaaatctgtaagtgggtggtattcactgttattcatcctgaactttaggaagtcctgcctttgagacagagaaataaagacacatctgctaggacaatcctcattttggtgattgtactgccttttgcatttttgcaagttttataataaaccattaatacatactgggatttgcagggttttttaaatccttgcagaactcacagtctagtgttttgtagtttcagaaagcatttcatgtcttttgtttcatttgttttctctatttcagagaggcttagtgcattgttcagaatcattaagtaaagagcaaatgaagagttgctacttaaccctagggaaagaaaatgcacctccatattaaagaccactctgctttcacactccacttagactgtacatacagtcatatgcctcttaacaacgttttggtgaacgatgaaccatatatgctacagtgattccataagataataatggaactgaaaaatctctaacacctagtatttactacagcatacttttaatccttattttagagtgtacttctacttataaaaaaagttaactgtaaaataggctcacgcaggtccttcaggaagtatttcagaaaaaggcattcttatcagaggagatgagcgcttcacgcatgtcactgcccatgaaaactttctagtgggataagatttggaggtgaagacagtgatattgattattctgaccctgtgtatgcctaggctaatgtgtgtgtttgtggcttaatttttatataaaatttttagaataaggatataaagaaagaacatatttttgtacagctgtatgatgtgtttgttttaagctaactctcattgcaaagattaaaaaatgttaaaaaatttaaaagtttataaagtgaaaaagttataatatgctaaggttaatttattattgaaaaggcaattttataagtttagtgtcacctaagtttatcatggttttgtttgttggtttgagacggagtctcattttgtcgcccaggagtacagtggtgccatctaggctcactgcaaaatcaagcaatcctcctgtctcagcctcctgagtagctgggattacaagcctgtgccaccatgcccagctaatttttgcatttttagtagagaaggggtttcaccatgttgatcaggcaggtctcaaacccctgactgcagatgatccacccgcctcggcctcctaaagtgctgggattacagatgtgagccactgcgtccagcccatgtttttaaagtctacactagtgtgcactagtgttctaggccttcacattcactcatcactcactcactcacccactcacccagagcaactttcattcctgcaaggttcatttatggttaagtgctctataaaggtgtaccatttttatcatttatatttttactgtatcttttctatgttttgatatgtttagaaacacaaataacattgtattacaattgtctacagtattcagtatagtaacatgctgtataggtttatagactatgagcaataaattataccatatagcctatgtgtgtagacaacatcatctaggtttgtgtaagtacactctatgatgttcatacaacaaaatctcataatgacacatttctcagactgtatctctgtcagtcagtgtttcatgattgtgattaattgccctcaataagctgagtaatttcaagtagttgtgaattaaaattttgatgggtctgctgattgtgacagtttttatgtaaaaaaaaatgtgttttatattgtttcttgggtgagacctctctgcttttccccaccagttgctaactaagagcagcaggtataaaatagaaaaacatgattattcttgaagtgtagattagaaagattcaagttcatttcctacaacctgatacacatacaatggaatagaagagcaaaagagaagacaaggtatcaccactgttctatccttgaaaatttgtctgatacaggaaatttatcagcataaagctaattgccagtttgagatttaacaaatccacttgtttgccttaattagtacccatttcccaccaagaaaaccttgataaaattccttaaaaagctggccttttttaaacccatgcaccttaggtgagtaatattaattagatattttaattatggattccatgtgcaaactttatcagtgaaaaactgctattatactgtggcactcttactttaaattgactctgtaataactctgaaagctgtgtaaagtaaaattaaatccttatccgtagacaattgctttagcacttgttcctgtgttcatgaggtaccaaggttaggctgctattacttactgtgaatataaatttaaaagtccagttatttgcattcttgcttcggtgtaccctgaacataatgaattaagatatagagacactatcaatataaaggtgtaacatcaaagaacagtaattgatttcctaaaataacgtcatgtatataaactccaaaccagatttttaggtaaggaattgtgacgttagtaaataaacttgtgatttgaaatctatagtgtttaataatttgtgggaatttttttgtcctattgtctgttctttatttttcccttgtgtgtctgttactaaaagcacataatttatcttcatatgttcttaaacttatctccaaattttaaaaggattttaaaacacatgacatgagagaggaccagaaaatattcatgtgtatatactaagatattatgttaatagttatatataatttggagggtgactatagtctgaaaatactaaaaattttttttattgaactccctgattatttattctgggctatgctaaactcatggacattcaggaaaaattagagataaaaatcattttatccatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctacaactagaaataccatttgacccagccatcccattactgggtatatacccaaaggattataaatcatgctgctttaaagacacatgcacacgtatgtttattgcggcactattcacaatagcaaagacttggaaccaacccaaatgtccaacaatgatagactggattaagaaaatgtggcacatacacaccatggaatactatgcagccataaaaaaggatgagttcatgtcctttgaagggacatggatgaaactggaaatcataattctcagtaaactatcgcaaggacaaaaaaaccaaacaccgcatgttctcactcacagatgggaactgaacaatgagaacacatggacacaggaaggggaacatcacactctggggactgttgtggggtgtggggaggggggagggatagcattaggagatatacctaatgctaaatgaggagttaatgggtgcagcacaccaacatggcacatgtatacatatgtaactaacctgcacattgtgcacgtgtaccctaaaacttaaagtataataataataatataaaaaatcattttaaaatacacatcacagatgcttatgcagagaccgatgaaaattctgcattcattcactaagttcaatgcaacttttgagagctaactgaatgcattgatgccaagggataatacatcaactgaatttttattgtgagccatttatcatatatattttcctatgtttccagacattaagtccaccttgtataattaattttattagtttggttgcttaaaatatacccttcaaatgcaaaagcaattactaaaatggagttgaatcctaaaagtcactatagtgtgcacctctggtaacttcatttttctttccttgctaacctttgcttgccccaaattacacacaaagtaaaacataaaatctctcaccatggtagctttaccctctaaattgtactcacatactcagttcctgaacttatattttgcaattttccttcgtatccccttcatacaatattacatactatctaccacataattcctttctattattgcctctgaatttttttatactatttcatttcactggaatttaattcattattacattgttattcttaaattccataactgtgagacatgtcccccaaaaggaatttttttatgttctgaaagcattttatcatttattgatatataactcactatacaactaccaatttgcagtacaaaattcagtgattttagtgaattcacagaggtttgcaaccaccactgcaataaattctcataacattttattcacttcataaagaaataccatacccatcaattgtcactcatcattcccctcaataccctcagttctaggcaaccacagattgactttgggtctctatagatttgaagattcaagatatggcatataagtggactcatataacatggggtctttatatgactggtttctctcacttagtgtaatattttcaatatttatccatgttgttgcaagcatatttattttattgccatattaaatttcattgtgtggatatactacattatatatgtccattcattagttgatgaacatttggcttctttctacttttgactattatgaatgacaatgcttgaacattgtgtacaggtttgtgtatagtcgcatgttttcccttctcttgggtatatatctaggagtggaattgctctgtcataagggcaagtttgtttaaaatactgagtaactgccaaacagttttctaagatttttggaacattttacattccagccaacaacgtgtagagattctaatttgtttacatccttattgatatctatttgtaatgtattttttattacagccatcaccctaatgaatgcaaaaatatatattactgtgaatttaattttctcttcacaaataactaatgataatcataattccatgttttctttagccattttttatcttcataggaatagtgtctattacttttttgcacatttttattgtttttttttttagtttttagttttaagagtttttttatatacttaggaaacaagtcttttattatatgtataattttctgttgattgcctttctactttcttgatgttttaccaagcacaaaatttttaattttgatgtagtctaattatctatttttcttttgttgtttgtgctttttgtcatatttaataattaatcacataatccaaaatcacaatgattacttctatgttttcttctaagagttctatggttttatttcttacgttgaggtctatcatctatctggaattaatttttgtgcatcgcgtaaggaacagttccaacttaattgttgtgtatgtatttatccacttgtctccatatcacttcttgaaagatttaccccattgaaatctcgcaatactcttgttgaaaatcagtgaagaggcttatttttgaattctgaattctgtgtctatcctatgtcaagatcatacttttgattaccgtggttttgtagtaagttatacaattggaaaatgtaagtcctttaaatgtgttattcttcttctaaggttgttttggaaattctgggcccttgaatttcagaatgacttttagatctggcttgcgaatttctgcaagaacaaaaaaagcactttgatcatgatagggattgcactgaaatcatagatcaattaagagatatattgccatcttaatgatattaaatctcctaatccctgaacataagattttttcccatttatttatattttatttaattttttaaaataatgttctctagttcgccgtgtctaagactttcacttattttgttaaatttattctttagtattttgttttttggggtgttattgtaaatgtaattaatcacttggtttaatttttggtttgtgaatcactaatgcatagtaatacaattgaattgtggatgtcgatcttagactctgcaacctcgatggtcttaattatcacttttagtaataatcaccactaaattactactacagaaaataatttaattaggaaatgaattccttagaattttccatctgcaaaattatgtcatcttcaaatagagatacttaaaaatttcttattccaagactttattttttccttgccaaactaccttgtctagaactttgagtacaatgtcaaatgggaatggtaagagaaaacgtccttgtctcattccttatcttaggggaaaacatttagtctttcacctttaagtaagaggattctcttagttttccattgttgtccttcttcagtatgagaaagttctctctattcctatttgttgaatatttttaatcattaaagagtgttagattttgtcaaatgttttttgcttcatctattaagatggtcatgtgctttgtgttctttattcagttgttaaactatcattagatttctgagatgaatcacacttgatcgtagtgtatagtactttttatatgttgatggatgtagtctgctagtattaagtgaaatttttttgtctatattcattaaagatattactttatagttttacttactcgtaatatttcggtttagcatagtgtatagtactttttatatgttgatggatgtagtctgctagtattaagtgaaatttttttgtctatattcattaaagatattactttatagttttacttactcgtaatatttcggtttagctttcacatgccagcaatacatagaatgggttgggatgtaatatattctattctatttttaaaaaattgttggggagaattggtattaattttttcttaaatatttgtcataatttatgaagtaaggcatctgagccagaaatttattttgtgagacatttatacttttctattttaatctctttactcattatagattgtggtagacagaatgatcattctgcaaaaatgttcacctcctaataacagaaactgttgatatgttaatttatatggcaaaagactctgcaaatataattaatttaagagccttgataaagggagattattctagataattttggtgattgcaatctaaccacacggatccttaaaagtggagaacttttctccgctctgatcttagagagatgtcattctggaagaaagatatagaaaaacgtaaagtttctggctttgaaaatggagaaaggggccataagcaaaggattgtggctagcatctagattctgggaaggttacagaaatgaattttaaacaagacctaacaaaatgaaagtaagccctggtaatatcttgattttattcttttgagaactgtgacagttttctgacctacagaaatgtaaaacaatacatttatgttgatttaagtcactgaatttttggtattttttttgcagcagcaatataaaataaacacataagtcttctcaaatttcctgtttcttattgagtcagtttcagtagtttgtgtctttctaggtaattttctattttatcaaaagtgatgtaggccgggcgtggtggctcacgcccgtaatcccagtactttgggaggctgaggtgggtggatcacgaggtcaggagattgagaccatcctggctaccacggtgaaacctcgtctctactaaaaaaaacaaaaaattagccgggcgtggtggcgggcccctgtagtcccagctactcgggaggctgaggcaggagaatggcatgaacccgggaggcggagcttgtggtgagccgagacctcgccactgcactccagtctgggcaatagaatgagactccgtctcaaaaaaaaaaaaaaaaaaaaaaaaaaaaatcagtgatgtaatttgtaggcatttggtagttcgtagtattcatttaaaatctttttgcatttctggatagccagtcataaagtcccttcttttattatttctgagtcagtaatttgagtgttcttccttttttaatcagcaaagggaaggttttgtaaaataaaaatgtgttggtcacagttctggaagctgtgaagtccaagattaaggcaccgacaaatatgacatctggtgaagactcactttatgattcagaaacaatgcctttttgttgtgtcctcagatggtgcaaggggcaaaacaggttccctccagcctgttttataagagcactaatctagttcgtgagatcagagacctcatgacctaataaccttccaaacaacccagctcttaatacctaccatcaccttaggggttaggtttcaacaagtgaatttggagggacacattcagactacagcacaccttttgattttttggttttctctattgttatctcttccattaatttcatctataatcattatttcctaccatgtgttggctttaagtttagttttttccttttttaaaatgtatcagtgtctttaggtttaagttaggttacagatttgtgattattattttttaaaatatatatacttacagatataaatttcattctaagcatgggtttcactgtatcgtataagttttattatattgtgtttccattttatctcaaaatatgattgaatttcccttgtaaattctctttggtccattgattgttaaagagtgtgttgtttaatgtccaaatatttgtaaattttctcagttttgctctgttgttcgttttttatttagttctattttggtcagagaaactttgtgtgatttcacatattttaaacttattgaggctagttttatggcctacaatatgatccttgaatacgtaccatttgcatttgaaaagaaagtatatagtgctgtattggataggttattctgtaggtctctcttagatctagatctagatctggttggtttatgctgttgttcaagtcttctatgtctttattgatctttctacttgttccatctactgttgaaagtggacactgcagcctgcagatatggttgcattctctatctcttaatttgtccatttttttcttcatgtattttggtgtcttgctgttgggtgaatatgtgtttgtaactcttatatctttgtgatggagtgcccctcttatcattagaaagttttcatctttatctgcggtaattaaaaaaaaactttttatagtctatagtttattactaatatggttcctctagcattcttgtggttgctatcatttccatcctcatattttccacctatttgaatctttgagtctaaagtgtgtctcctatagacaatataaagtaggattttagaaaattctgtctagcaatgactgctttttgattagattgtttcatttatttacttttgatgtcattgtttatatagttagatttatgtcttccattttatttttgtgttttctgtatgcttttttgggtcttgtgttctttttcgcttctttaattttcattaagtaaatactttttggtgcaatatttcaattactttaacaatatgtttactttttaaaattttcttaatgttcaatctagagctcaaaatatacatcttattttaaactacttcacctccatagtcaatttaactccagtgagatacagaaacattacactatatatctctattccctttctacccctcttttttgtgctacaattttatacatattacattgtacaatgattattttacttcaaatctgttgagattccctagagaacatttcgtttcaacatctgtacttttcaattccaagatttatttttggtttcttacaataatttttatctccttattgatgttttctattttatgaggcattgccatcttactgtactgtatgttgttaaatatttcttttagttctttgaacacatttagaatagatactttgaagatttgtctgctaacccagcatctgcctgtttttgtcattgttttgttttcattgtttttaacatgtgcatgatcatactttattacctctttgtagaccgtgtaattttttgttaaaacctagagttttaaaaaattatatattttagcaaatctgcatactgattccctgctctatactggagattatatttgttatgttcttgtttatagtttttactaacttggtttgactactttattgaagtctatttcccccccgtattgtacaacaatctaatattgatcttcaaatgattcagccttgggaatgtgcatattctctgggcgatgcagtaactgctttagtcagactctctttgactgtctctttcaatgatttctctggtaagctatctgacactccaagtatcacacccagttgttaccctctactaattcctatctgattgcactattatttttgacaatactctggggctggaatatctccccaatatagtccaatcagaataggactgattttcaggaatcaaaggccaacgtttatggcttattctgactgtgctcttcggtctacactttcctaaactttttcattctaaataaattctgcttccttgggaagatacatgatgctctctgttttcactccctttttctcttcttgggtcaaacctctgtgttgttcattaggaaccacagatatgctttgccattctgagggagatgtgggttgtggtgccaatgccacaggtttgcattgcttctatcagaatttagtagattttattttatttgaggaatgtcctttggaaaatatccagagactttaaattgtttgcttatttgtaaataattttcacgagttatttttttttcctggggaccaggttcatagctcttcactattccagaaatcagtcctcaaataattttaataacatgttttaaatattctttatgtaatgtaatgctttgcatactataagcatgttaaaggtagtagctatgccttagttgtatttttcatacctggaatgacttatcacagccacacatctgcacacattataatctcagtatgtgctttttgtgctaaatatgtagcacaaggtcaaaggcttacctttacaacttccttatttcttatagagtgcggagcctgaaaacaggttttccaattattgctgaaattattttcagtgtagttaaatagattgttagagaaccactgaataatatgtaagccaagtaaagatgctgcttctgttattgtcatcataaaatacccaaatggaaactttactctgtgctaggtcacagattaagctaaagagtgtcatactttatggcaatgcataatgtggtgccttatttgtcagaatgagttaaattgactctctaagtcactgctgagcataaagcaaagcccctgagggagaatattgctgaatttattccatgattgtcagatactatattagtatcttattgctggtgtaagaaatcacaaatttatttgttttaaaacatcatttatttattcttacaattctgtatgttagaagtcaaacactgatctccttgggctcaagttttcagcaggaaagctacctttctttctagagactctagaggagaatgtgtttcattgacaattccaactttgcaagccactcatattccttgtctcttggtgttcatcctcaaagccaataatggtgggtcaaattcttcatacattgcatcattctaacattctcttctgctgttttcttccattcttaagacattttgtgattacaatgtgctcacctgaataatctaagataaatttgctctgcctatgtaattaggaagtgggtactatttttatatccatttaactcatggcaaaattgtggctcagaatattaagtgatttgcccctggtgcagtaaaacttgaaaacatatggttcttatgaaatgaagtatcacataccaagagctactgggaaaattgcaagcacacaactatggagtatgttaaagagcattgtaatggatataatgcatttgatatataaagccaatatatattttatttcttagaaatcttgtttctctgcgactcaacatcctttgtaccaatgtcatccatcatttcatgtgcagagcaagtatatcttagaataaagtggtgattcctctggttaagattcaaatcagactttttgatcttaaaaaaagcacgatcttaagaaccaggcttttctgagagtaaaataatttttctaaattccaaagttttccttggctagaaaaaaaaaaagcatgacattctgagtaaagatctcttaaagagaagataaaagacatggtttaaagggagtttctatcccacagcaagaaataaagcctttctcaacagtaggtagtttagccaagaataaagattcagaggagataaggcctgggttaaatttctgtctaaatttctaagaacatatgtctcagccaattaggccaagacccaaagcatggaccaaaaggagtaaaatcccacataagcaaagtgggtggctgacaacaaaacatttgaaactcattttttagaattccccatgaccaaattgggtgattagggaaaagtaaaactgtggtatggtagcatgtgtttaggttgagaaagggtttgacaaaatgtagctctatttccccacagcctgcatctgacattgacaaaaatgtatgtgttcctatgtgtcttgtgggatgcaaaaggtttctgtgaattacaagtcagcagactgtctaatgattttctatgctgaggtgtaagatgatagcaagcctattgtgaatctaaattaaaaggaagggatgtggcatggttgagaagcgcaagattaacagaatcaactaaagggcagtcagaggagctgtctggattttggggactaatgctcaagaattatctaggcagtgaatacacagtttatgctagttattttttaagcagccaatccattatacagacgctgttgactaaagaaagtccacatatcaacatatcagtcagaggtcagcagaagacagaagaagcatttaaaaaattattgtttacccctctcaggttgttatatgagctattgggtggttttataccatcaggtaagtatgaaattttattgagatacgatatgtgagactaaggtgtgtgtatatgttggggagaatacaaaggatagttggctagactgagtggtgaaaccttaaaagtctaattatttatcaaaaggaaactttgtttaccttaaaaagatcatgttgaactagaaaagactgaataacttaaatggacaatttttttttcaatttgtttttatttgtatttacactgtaagcagtcctgaagacactagaaatagataagatcagtcatgaaaaactgaaaagattacctttttcatatgtgtgtcattgtgtgcaaaggttgacttctgctacagcagatataatccttctaacatattttgcatcagtggaatttttcttttcaattttattgcagcaccaagttttattatatttttgttgaaagatacatagaaaataaatactttctgatattttacaataacagtgaaactatttcaaaaggaagaaagggattgaaccattatccaagcaacagaacatataattatgccaatgaaaggggctgtcttatcattgttcttagaatcttaagagataggtgcagatagatggatgtatggatagatagatagatagatagatagatgatagatagatatatagatagatagatagatagatagatagatataaaaacaagactcagatgactacacgaggtctttccaactttcaaaaacatggaattattttgccttttttttttggtgtttttttgatgttgtgattcagtttgtcatttgcctgagaaatcagtatgagaaatttgtattgatcactatttgaagagcatataaatatataattttcatggtaaatattcataaattggaaccatggtattaaagagaaatttgtttttatgttgctgataattgattccttcaccctactctaaacagtagcctttctaaaatggccatccaagcagccattggagtttaaatggctggaagcacttttattcattcattctttaaggctcaatcttacctcatccaggggctgcattacgttcacatagaagaaacaaaaaatgtcagcaagtattgggatctgcagatttattttaaagactgggtgagtctatattctcaaaagtgttgtacttttgttgtaacaaaatttgttgtaatgtgtggcacctgccttttaaataaatattatgtgtgtttcaatgtactcaatttgtgtgttagtcatacatactgaattgacagtagaatgtcagttaatttaccctgagaaatatattaaccatatttcctttgcttgctcattatctcttagtaaaaaatatgtaggaaaccaatgtcataattgggactattttggtcagattagaattacactaagatgaatctgttgtataattttaatgaccaaagacttcatagataatgaaagatgaatttcaaaaactgtgatatgagtggtatatagatgagagatatcacagcccagggtataggctcccttcctcttgatgacaccggttgttcactttcaagttttacttttcttgctgttgtattaacattttattatctgctcatttgccctagttgaaacaatgatctcaaagtaggagtctcctcacgccttaactgtgctccttgggttaacactgtctcttgggttaacacagtgttaggagttgggttaactcctcagttaaggagtgagggaatgaacagagaaagaacaacaccctaacgttttatttttacatttgttacgcaaaaacatacacaatgtctaaataatgttgattgctgggtctttttagaaacacagctgtgaccatacattaggaaacacccccgcccctgacaatttcaaataatagtttacaggatgattgcctgaataaaaaagtgattcttatcattttttgaaataaatttgaagaatccgtgcaatgtacctttaaatcataattttctctagtaaatttaagcactttacaaggtgatcttattacttgatggagcaattgtatgagatggattattcaagctggtgttaggaattagttaagtgataatcagacataatatcaaattccttgtgctcctctaataaaatcagaggtaaatagataattcaattcacaaaacattgaataaaacacaatatttgagaacttcatctgctgtgtataataaggtacatctgtattagcaatgctctattcacagttaccaccaagctatcttctaaaacacaaataaacaaaatgttaatttaatgactattgccttttccttgtggactgagtaatttaaaatgcattacaataggttttatgtttatttgttaattaattgcaaaattgaacagctattatgtataagacactatattgagcaatagaaaaaatagtaagacgtaataagacataacactagttaacatttctagagtacttaccataactcagcactgtgctattaaggtttttgcgtgacttagctcatttagtccctttagaagcctagaaattttgtctcagtgttactaaccattaacaagaagtaaaatgaaaatacagatagttttaaatataatgcaaacttatatccttgtttttgcagatttgtatatctggtttatgcctgttcttcctatgtaattattaatagaacatcctctgcctttgaagaatgtcccttgaatgatattttacatcgttatcccatttaaataacttgcccaaggtcacacagctagttactggcagaactatttcttaaacccagattttctgaagccaaagcctaaattaaaccatctcccacagctaaggaatactttttagtttaatgtctatatatgtgtgtgtgtgcacatgtgtgtgtatgtgtttgtattttaatggaacatctttcaaacccaatatgttcaaatgaaactcagctttctttctaaacttgttccatcttcctatattcactatcttgaatggcatgaattacttatgctaggaacatgagagtcatcccagaataaaatcctgtctttattcatattaagcagtgtcatcaaattctatcaatttatttcccttaaatattttcttaaatcctttttttattctgcagcaccaaaaattcttccttaagttgtgtattaggtagaatgaacatgagaaattcccattcacttgatccttccaattctatcttctttcctaggaattcttactaactctttggtatttcttcttcatagactatttgtatacattgatatttgtgcaaccaggatgtagcatatgcaagttgatttctatcttccttcccaggaattcttactaactctttggtatttattcttcatagactatttgtatacatcgatatttctgcaaccaggatgtagcatatgcaagttgatttgtagttccagtttgagtctgacaaccattgttataagtggtataagttccagtttgaaagccttaaggcttgagacctaaaaagagccattatttctgtttgagtgcaagggctggaagagactgatgccctactcaaagcagtcagacaagaggagattccccttagtttttttattctattcaggtcatcaagtaattggatgaggcccacccacattagagaggtcaatctgctttatcaatgtgatgattaattttctgtgtaacttgacagagctaaggaatatccaggacagctaatgagacattatttctgagtgtctattaaggagcttctgtaagagattagcacttacatcaatagactgagtgagcaggaactccctcatcaatgcagatgagcattatccaatctgttgaggatcccaaaaaactggaaaaaataaagcagaagaagagattaaaaagttattccctttactggagctgggacattcaacttctcctaacaagtttatgggacttgtcaggctccataattaagtaagccaatcccttataacaactttaaaaatgatctctgtatatatcatattggttatgtttatcgagagaaccttaactaatacacttagttcaatgattaaaatgtcaatatcatccagaaacaccctcacagatatatctgggataatttttggctaaatatccagggaccccttggcccaatcaagttgttacataatcgacacagtatatgttagccttggtctctttttttaagattccacacataaaacattcacatatgcacatactgtacatatagacattagtaaatatcagatatttactaataatctagtgataattttgtaagagacatggaggaaaacatatataataatatctattactaaaatattatgagtgtctttgatttcatctaaaatgcataaattttcccctaactttatgtattagtccattttcacactgctataaagaactgcctgagactgggtaatttattaaggaaacaaagttaattgatacacagctcagcatgactggagagggctcaggaaactcatgattatggtagaaatcaaagggcaaacaagtcaccatcttcataaggcagcaagaagaaggatgaacacaagaggaactaccaaacactgataaaaccattagatcatgagaatttactcactctcatgagaacagcatgggagaaaccacccccatgattcaattaccttccaggcctctgggcctgcactgggaggaactgctgtgaagacccctgacatgccctggagacattttccccatcattatggtaattaacatttggcttctcattacagccagcttgaatttctcctcaaaaaatgggtttttcttttatatcgcatagtcaagatgcaaatttttcaaatttttatgctctgcttccctttaagttgcaattccaaaccatctatttgtgaatgcatacaactgaatgcttttaagggagcccaagtcacctcttgaatgctttgctgcctagtaatttcttccaccagacaccctaaatcatctctctcaagctcaaagttccatagatctctaggacaggggccaaatgctgccagtctctttgctaaagcataggaaaagtcccctttattccagttcccaacaaattcctcatctctatatgagaccatctcagtctaggcttcattgtccatcactatcagcattttggtcaaagccattcaacaagtctctaggaagttccagattttcccacatcttcatgtcttcttctgagccctccaaactgttccaacctctgcctcttaccaagttccaaagttgcttccacatttttggatatctttacagcagtgcactattatctcgataccaatttactatattagtccattttcccactgctgtaaagaacttcctgagactgggtaatttataaagaaaagaggttgaattgactcacagttcagcatggctgggatcctttggaaaacttacaatcatgacagaagtcaaagggggaagcaaggcatcttcttcacaaggcagcagtaaacagaattgaaatggtttggctctgtgtctccacccaaatctcatcttgtagctcccataattcccatgtgttgtgggaggaacccagtgggagatgattcagtcatgggggtgggtctttcctgagctgttctcatgatagtgaatgagtcttacaagatctgatggttttaaaatcatgagtttctctgcacaagctctcactttgcctgctgccatccacgtaagatgtaacttgctcctcctttccttctgccatgattgtgaggcctccctagccatgtggaactgtaagtccaataaacctctttcttttgtaaattgcccagtcttgggtatgtctttatcagcaatgtgagaagagactaatacaagaatgaacacaggaggaactaccctttataaaacaattagatctcatgagaactcactcactatcatgagaacagcgtgggggaaaccactcctatgattcattgacctctgccttgtctctctcaatacatggggattatggggattacaatacaagacaagattttgggtggggacatagtcaaactatatctgtttatatttgtattctatttggaaattatgttggtattagtgtttttgaaaatttaattaatatagcttaaattttggagaagtcttatatttacagaaaaatcaagtaaaaaatacagtttgcaaatatttcctcacctccacccctacaaaatataggttcccctattcttaatatctttcatgagtgtagtgtatttgtttaaattggtgagccaatattgacttattaaccaaaatttgtattttacattagagttcacattttgtgttgtatagactatgggttttgacaaatagagaatgacatgtgtccaccagtacaatatcatacagaacagcttcactgcctgaaaaattaccctgtgttcctattcattcctccctcatgcactctaaacctctagaaatcactgaaagttttacagtctccatagcttcatctttcccaggatttcatatagttgggatcaaacagtaggtggcatttttagattggcttttctcacttagcattatgcatttaggtttcctccatatatttttgtggcttgatatctcatttttaaattactgaatgatattcaattttatggatataacaccatttatcctcacctatagaaggacatcttgattgcttctacattttgacaattatgaataaagttgctataaacattgtgggtgaattttggtgtggttattagttttcaccacatatgggcaaagatgaaaagttatgactgctgaataatatggtaagagtgtttttagttttgtaagaaactgtcaaactgtcttttaaagcggttatagcattttgcattctcatcgggaaagaatgaatgttacttttgctttacatccactctgacatttggtattatcttttgaattttacccattctaataggtaaacagaggtatctcagattttaatttgcagttcccaaatggcatataattttgaggcatttgcttgattgtcatctgcatattttctttggtaaagggttggtcagatcttttgtccattaggaattgttttgttttattttattgtttcccttaataattatttatatatttggaatccaatacctctatcagataattatgttgaaaattgcctcctcaatccgtggcttctcttttcattcttttaacgtatcttgcacagttcagaagtttttaattttaataaaattcagctattcaagtttgtctttcatggatcatgcatttgttgtgcctaaaaagccattgtaaaacccatggtcatctgggaatgttatagttttaagttttacattggggcctataatccattttgaactaattttcatgaaaagtctgtgtctagattaatattttatatttggatgttcattagttccatcactgtttgttcaaaagctattattcttcatcgaattgccttttgctcctttgtcagagattagctatctctatttgcataggtctacttcgaggatctctgttctgtttcattgatctgcctgtgtgtttccaccaatatcacactgtcgtgattggtgtagctttataatacaccttgaagtcaggttgtgttgtttctctaactctgtttttctctttcaaaactatgtttgctctctggatcacttgcctctccatataaattttcaaatccgcttgtcagtattcacagaataacttgggattttgattgagattgcatgaatctataaagttgggaagaaatgatgccttgacaatattgagtctttcatcaatatacatagaatatctttccgtttatttagatatatctgatgcactttatcagaattttgtagttttcctcatataggcattgtacacattttgttagattttttacccaagtatttcattttcttggatcttatgtcaatagcatcatgtttttatttttaaattctaatttttcgttactggcacataagaaacctaccaactttttaaaattaactgtttatcttgcaaacttgctatattcacatatagtttcagaagggttttttgttgattctttcacattttctacataggcaatcatatcatctgtgaacaaagacagttttattcttttcttcccaatctgtatttttaaaagtttctatttcttatttcattagttaagtgtaccagtagaatgttaagtagaagttttgaaagaggatattcttaccttgctcttcatcttcatgtgaacgcacctagtttctcaccattaagtacgttaagcatgttagcgctagttgtttttatttgtttgtttattattttgtagatgttttttaagttgaagaattcctctttcctctttgttcataatttgctaagtattttcatgatgaccaactggtgcattttgtcacattcctttcctctatttattgatataatcatatatatttttcttctatagctgttgatgtgatgaattacattaattagcttttgaatattgatgcagaattgagtatatgaaataaatcccactttgctgtagtgtatacttttagtacattgttggattcaatttgctagtattttgttgagagtacaagtttctgaacaggaatttatttcccggtttccaaatttctaacaatttttcttggcttcttaagaaatcattataatacacctaatctattgctatagttgatacctgggctctccggttagcattatttttttcattcatgtctttttgacgtagcttcataatatgctttgatatatatcaagtcacttctaatagtctaaaattattctaatagcacttgtacatactcttacaaaggaaacttttagtcagattatcatattctatgaaaattccacttaaatattcatcggtatgtcctagaatttagagattaatactggtaaaccaatgcttataagatattaaaactgtatattaaggacaatgaaatattttaaacatttttatcttatgtccctcaaatattatttacaattttttaaaaaatattatctaagtttctttctagcatttaaaatacatttaaaaaatatattttcagttttgtttaatattttgataggatttttttctggtactttaagtgttaattcttcatgtatagataatgctcagtacagacttttagggagggaagccaaatatttaagaatcaatggaaatcttatcttttctatatcatgttttacaagcactaacactgtcttgttagttttctgtttaaaatctctgaatcgtgtcctatcatctaaaggataaaataatagaatgtcattgaagcaccacattatcagacattttcttacctctgcaatttaatctcttgtctcctaaattattttagcttaacttatcagtttcactcaggcctctattaaattgcgcatagagtctcatctatcaggaaaacacatcctttccttctgggctttttgtaataaagtatcatccattctcaaaaaaaattctaatatcttcctacaggttaatatttcccatcttctcatctctattgaacatatcttagcattatcctacatgtaattttctcgtattcccttcttacgctcttcttaaaagattgtcttggcagtcctatgaaatttagcaattttgctaattttttatgacagaaccttgtctttctctattttcaaaatctaccattatgccctgacctctacagttattccaacaaaacaccatttcttaaagtctgatttacaagtcaatgttttgccctgaaatcctccaggtaatgtctaaatagatctgctttacacttgtattttctaatacaaaaatacttacaccaatttttagctctggtaggattttataatttgctgaagaatattgttacttattttaaaggtgttctcccctttattaaagtttgttgggactataaagaaggaagttgattagtacagatcagcataaaataattttgttccttgacacaatctttagaacaaaatagataattactagtttagaggaatatacatttaaagaaggaatatatgtgccttgtgaatatgtcttatacatatatgtacaaatggaccttattatcttaatgaaatgtatgaaagatagttcataaaaaccatacaaattcttggtttcaggtcattttttaattgtgataaagtattaatataattcattacgtttgttattgtccaatagtgaattgttttttgcattaattggattcagaagctttcttggcaagaaaaaacaaatcaagctggcactatagctgttttccttgactaaaataatgcttaacaaattacttagaagcttgaaggccaaaacatacaggtacaattaacatatcaaataattatattgctccacaatttatagaaataagaggaaaagaacttttgttcttttgtttttctttttacctcatctgtaaattgtaccaatgttttaaaacaatttttatctcagattttaaaaacaactcaaaacttaaaagtattttggtttttgtaagcatttctccaaatggtgattgttttgtttacctacaatttcaatatttttagattgatgttcacattcttccagtaaaaaattaaataaaatagtaccaattgacaaggtatgtttgtttcatattttcttccatagccctcttttctaaatgtagctatgttcagagaaaagagataattcttgaactgtttatagaataagtactaatattcataaaatcaatttgattttcttctttttatgtagtatgtaattttttcagtaaataatcaaaaatataatttcataggtcaattaccaaataaaatgattttgtcattctgtaggcacacatcttgaaactacacctgtaaccttggcagagttacccatatttgacacttgtagcagcgcaattaatttatgacattcagcacactatcaacatgctctgactaaaaatccaagcaaatttcttaaatagacaaatttactctgatttctgaaaacctctagccacttacatgcactacatataattgcaaagccataatgaaattcagcatttcattataaaattcactttgaatttcagtattgaaatactgaatttcactttgaaattatttgaactttattattttaatgaaatgtatgaaagttcagaaaatattatggatgaaattacatccatattattttcttcctcaaattggagagctgagacctgctattttcatgagctcagtgccagtattgattgacaggccatgccaaaaaacaagtatcattctattctctactacaggtgactagaccacataagtattgtgtattatatataaaattttaaaaactattagaaattgtttttcataacaggacttgtctatttcaaatctgtttgttgaaattatatcacatattttgagaatatactacatggtaaacaatgagttatataaactaatgatttttctccatgagtggcagattcatttacattaataaattatccaaaaaatagcactgtccttcaaatgtgcaaactcaaaactatgcaaattgaacttacatacacttaagataaaatattctttaaataactgagaatgttcataattattattttccttctaaagattaaaaaagagttctactttgccaaggaagatactatcttacataaacagcaaagaatagggtatatttaatcacggtatataaaattaatactatgtcataacaataatctaagagatggaattattggtaaaagttgttaaaattattatatttttattcagcagttatccaggactatttagtagtaatacttaacacaccttgaatatttagtatatatcatataaacatgctgtttggtgggacaaaaatagttgacattgagaaatattgtatggttcaaaccaatatttatgtcacttaaaacttttgttagaaaatattattgtaacaatacatagatgaggatactgacatatcattgaatatggaatatgctcgaaatcaaacagtgaatggtggaaccaggaagggaacctttatctgtccaaagctgaaccactgtgttatactgtcgctaattagatgaagcagtttggtatgacagaaaaaaaatgccctgtactgagttataagactgctatttgtgttacagttctgctcctggcccagtgatcattaacaaatcatttaaactttataactttcagttttctaactatcatgtggggataattacacttgtgttctctacttcacagacataaaaatgaagtgcaaacttcaaactaaagtatatgaattgtataggcagagtaaataaactgaatgggatgagaataatttgggcaaaaaaaaatcagtagtaaagaaaggaggttaggagaatccttctgaggataatgcaagcagaaattgaaagtgtggtagtcatataacattcagtttatttgagatttggagagcaaaatgcttgaactttttcttaagttcaatatgaaagacagcattacaaagaagtgtgtgtggtaggataaaaggtttttttcctccactttcaaacagaacaggtttagagcagtgaatacatggctgagtagcattttaaggaaaataaataagaaaaatccctgaatgtagcatcagtaattgcaatacacatttctcaaggagcaggaaagaaataccgtaactataatacagagatcaagcagaatggtactggggtggtagatctctccatagcaggaaggaaaatgccagaaaatacaatgatcaaaatgaaggaatgtatttgaattatttacatctccaacgtatccaattatcagaagccattttaagcttgtgcagttaaaaggtgaaacttataattgatataggagatcagaatatgacatcccaaaatatgccactttagcataagaattattatgaattaaaggaaaatgacaattaaacacatggaaagctctctgccttctccctgtttgcctaaaagcaggacataaatttacgaaagcaaaaggatgcctccttacctctctaccaggaagaaaaaaggttgacccactgaagacaactttagaccctttcaattagagaccaaaggaatctacattagcaaactttgctaactcctattctcaaatttgctgtccctagagattcaaagttcttttaatttgtcttatcacttctctaaaactttaccgttttttgttgaagatgctatataagctaaaattcaaaaccacctcttttagaattattcatttctttggtatcttccatgtatatgtgaagtacacagggtagtaaatttgtctcttttttttctcttggtaatttgtcttttgttacaagggttcatctcagataagaagtatgaaggataaagagaaaattggttttgtcttacctacgtcaccatggtatcccatgaaattcaaggaaaaaacaaacacaagcaaacataacctaataaaacaaatgcattcaaagtcactttgagaagaggaaaaagaatcaaacttttggcagacaaaagataaaacccaaaataatgaaagagaactgttacttgactctcccacataattaaaagagcattttcagttatgaattaaacatttaaatatcaaagatagaaacaaacaatagtaagattagaaatggaatctaaactctgaagaagctgaagaaaacaattatatcacctcagaatttaaaaacaaagctgccaagtatagtacaacttactatacaaaatagtatgatagaagctaggaaagaataaagccaacaccatgaaaatagggcataaaagagatgaaatgaaacagagaaaaggatagtcaaaaaaaaataccccactctccaaaatgaccagaatacttaaagcaaaacttctagataattttcataaaagaaaagacatccccaacatgcatattaaaatgacacctatgttctttgtaaaactgactcagaatagttcataccttagacatactgctgagcttaggaaaaagttataaatgagcagtaacgtgaggaaatactatacaaatacaaccttttaaggagtcaactaatggatgccttttattcaatgaagagttgaatgggaaaacttaaaataactataagtgagtatgagtcactgggtaaatgaaaatccaggagttcacagtgatcatataaagacatgagaaggcaggaagagaaggggaaaaggatgaagagaaaaaggaggagggggaaaggaggagaaagaaaatgaaaacaagatttgctgccattagaggttagtattattctaagaatttaacataaaaataggtaatggaaaaatataagcattaactattcctttttacaaagacctgtattactttcccagcaaatgagagaggaaattacacagaagaatgccaagtaatatatgtagaacaaatgattgaattagaaaaaccaccattttgcaaactctaatcaaataattggtacaagtaagaatcacaaatagatgttacatctattaattttggggaacaggaaaattttaaggtgaaaaggttaagcagcaaaagctacttgctaagatccacagaaaaacttatctttgaaatgaacacattttatgatcattttcttaggcaaggaaattaatatcactaatagtgagacaacatgatattatcatatgtgctcatcaatgtgaattattaagtgatctttaaaacaatctcacaaaaagtttaatcagcatctaacctagcctttatgtctatcatcgaatttagaggaactaaaggaatagtgtggaagacacaaagaggaaataatcagacaaataaaaattattctgtaggaaaaattgtccagttttcttgtataaatgtcatgaaaaaataaagtgaagcaattgctttagaacaaaagtgactgaagaacaaacaataacctatcagtttgttgactctcatcctgacatgtatctggccaggccaataggtgaggcaattatgtttagagacaatgcacacagaaaggctgggaaagatcatagtagtagtaatagccttttggtctttgaaaatttgtagtttacttcttttgactcaaatttgaagcgtccagtcttatgacctttattcttcttttattctacttcacctggaaaatgctttattcttgtatttaatagaatgcttgaatatgaatgacattctagtctgtatttttatatcaaacctctcacctgaacatcactagattctaacatctctgtcagtgactatctaggcaatctttgcccaataattcaagttgtgccttagtgtgattacatataatatagaaataaaaataccaggctgacttacctcaagagtctattctaataagctaataagaaaatatatgagaagttctaaaagctgtgaaataatgtgcttatgataatttgcttagtcttccctcaggtgtatggatatataaattcccttcattgaggtgggcagtatttcacaaaggtgcctataggcacactacctccatagagagctaataaaaaaactaatactcttgaactttctaccaatgctattttcttgagttcccatgtgatttatgggcctgatttcagtcaatatgtccataataaaaaaagattaagtaacacccagtccttgttttccataagtaaattaatcaattttaaaatgtcttttctcaacccaatattaagaaggtcaaaagcttcttttacaaaaataataatatggttgaaatttgtacctatagtagaaatagatgactgaatgcttttttataagctttgctcctttaaaataattttagttatcataaaatttaaaagatacattgagccaattttcctaggcatgtacagaaagatagtaatatatctacaagtgtacaacgtaggctggtgtattccagaataacagattctgataacagatcagagaacatcctataacacataggcacacaaactgcaggccaatcacaaggaaattaaaaacaggcctattctgatgctatgttgtgcttaaaacaaatcaatgcaaaggcaataacaataagaaagaatttaataaaagtatttagaacactgcaggaaaaatatatatcaaattgatggttgtgactgcccgtctggagcagccactacagtgatgccagctgcagtgttggaggagcagacaggggtgcatgctcccttgtgcccgctccagtgtggagcaaatttgtggctgagccagggtgctgctgtgacctggccagttgtgcacacactccaggcagcactgacattctagccccctgccaccatggcaccctccagactttgggtgctgacgagtgtgggagggaggctggggactgagggtgactcagtaccagcctgcaggaacccctccacatgaacatcctgggtgctatggatggcatgttgatggtggcgagaggcaggtttttaggtgggaataggcaggttttcagtgaagccccaccttcaagccaggaatggcttgaggcctaggggctaggctaccagttctggagtgggaacttatgctgatttttccaggcccacccatggctgcccatggaccaatcagcatgcacttcctcccttctgagaccataaaaaccccagccagactcagacattcttcagggtgacctgcctgctggaaggagctacccacttcgggattcctctacaatcttccagacaactgcctgcagttagaagctacccactttgggtctcctctgtactctttgggatgacctgcctgcagaaaggtcctaatcactttcggtctcctctactctcactgggacaacctgcctgcagataagaggtacctttgggtctcctctacactctttgggatgacctgtctgcagataggaactactcacttcgggtcttctctactttcactgggatgacctgcctggagatatgagttgcccactttgggtctcctctacactcattgggatgatatgcctacagataggagcaacctaccttgggtctcctctctgatgagagctgttctgtcactcaataaagctcctctccacttcgcttaccctccagttgtccacataacctcattcttcctggatgtgggacaagaatttgggatccactgaatggtgggagtgaaaggagctgtaacacttgcctgggcagctcgttgagctgcaggcagtgacatgctcctggactgtaggagtgaagagtggtgacgtttctgggagcccagaccttggtattccctaagacagagctgctgtaacactacagtcctgctgctctctgctggcactgggcagccaccccacgtgatgggaagcagtggtgggactggaccagcccaggaactgtgggccagagcagggtggtgggactgaaagagctgtaacataaatgggctgaaacatatctccccccatttgccacacaacaggcgatgagaaggagagaagagctggtgcccttctgggagcccagaccttggggctccctgaaccagggctgtgatatattgtgacacttttgggggctctgtggttcctggcatcttcaagattttgggtaccacagtgttcccctcatctagacacagctgacaacagtgggagctacttgctgtacattgggtcaagccatggcctcacacagaactggcacctgtgccggctcctggagctgcctgccttgccacagcagctgggttgcttgactgtgcactgtggctggactccttgcttgctcattcacacacccctctctactccactcctggctaacctttagcaggcatgggatccgggatggtactgccagccaagaacagcctgctgggccaagtgggtggaatgagcccagaaggcatgagaaatactcaggaagaaggcaccaccaaagacaaaggtttctggctagtgaagcaacacctgaaggatcctgtgacagaactgaactctgtttatgaaaaatgcgtacttgaaaatctgagaagatacaggcttgactactaaattccaggtcaagtacatctaactataacacatctaatttcatgtcataaatctctacgtagaaggttttagttaaatacaagggttttttgttgttgtttctacagtgattatcaggtgctttatgaaatagtttttctgacatttaaggaaaatggtgagtcccatggcccagtaaatcaaactagtatttctcatcctttctttccttagctgctaccataattctagtcttcagttccactggctgtaggtaataaaggcaattcttcctggaaggtgtcagtggcaaaagaaggatagaatatctgcttaactgacataaaatgtgtttttttttttttactattttaatggaaatagattgggttgaaccccttatcccacattctcactaaaatatctgtatattttacatctcagtaacattttacctcccgtatttttgtttcattgtttttctgtagcaactcttcgtgtaaattaaccagtgttcatgggttttccctgaaacaattcacttgactgaagatgttaagatgataagtttgtttcatcatgcagcataatacaaatgtaaaggtgaatattaggcaacactgtatttaaaaatcctttagcttccaactgaaagttatcaccagccaccattttgcaagatcctaacctggttattttgctagaactccccttttcaacttaattctctttcaattttcctatacagaccactttatctctgtacactgtattcttttggatgtagtccttcattaatgtgtttgcaaaatcaaatgccccaatacaattccagggtgttgttctaggtcccatttctcaccaaacagaaaggcaatcactgtgacaaaaattgccagggaagaaatctttacttggatgctacagctgagacaatggtgatgggaggtcaatctcaaatccatctcctgaagaggctaaaactagggaaggaatgtaactacatgtggggaaaaaagaattagggacaggtaaggaagaggagttggcaacaggaagcaggtggtcagttaggccatcaagactagtgaggcgtcttgtgtctcattgttcagatatggtgatctggtcagtttcattttcttggtactatctggaagccctgacggttggtttcctaagaaaagaacttagataagacaaatggaactttttcaagttttaaggctggctgagtcaatttctatgtttattcaaaagaaaccataaacattagttcggtggggcaattgggctagtttcaataccaggactaaacattgccagaagaactggcaaatattttggaatgtaagtacatttttgaccctaagtccccaaacacttagaaagtagcagtgactttaatcacttttcatataattatccttactctcctattataagaatatttcctgccaattttgtaggaggaaactgtatcagcctggaaaaatatggtttttctgtgatccctctgatctcatgtgctcattactggagtacatattctcaaaattgtataaagtgtgtggtcccattgtttccccaacaagatccagatatgaagacaacctgttccctttccatctatcacactgtgaatattcaaaaacctataagatccttaaaacatttagaagacaaaattatgttaataatatcactgatagcgtttgcaagggaactctaggaagtaagaggccattttccctggggcttaaaattacattatttttatgtagaggtcaagttctgaaaggcaataaagcttttaattacaattcccctgaaccacaaggtggaaaaaggtataactgcctcagagaccactaggaaggcactaatgaatgataatgtattctcagcagtcagaaagagcagccaactctgagataatgtgttacaacttctgtagcttttgcaaacacataggaaaggttttgttaatttgtagaatacttgaagtaccattttaaatatatttgataaattacattttactagagatctgacacaagagaatattagctataagctgcatattaagtatgtacatattaatctaagcataatcactgtaagttctgacccattcatgggcaaggaatgaagttactgctttttgaacaaaatacaatattttgcaagtaaggtagaaggtaaggtagtataattaccaatatgtatctcacatagtggcatggtttggttgtggccccacccaaatctcatcttgaattgtagctcccattatccacaagtgtcatgggaaggaaccagtgggaggtaactgaatcatgggggtggattttccccacgctattctcatgacagtgaataagtctcatgagatctgatggttttataaagggcagttttcctgcacacattcttctgcctgcttccatgtaagacgcgtctttgctcctccttgaccttctgccatgattgtgaggcctctacagccatgtgaaactgtgaatccattaaaactgtttataaattactcagtcttagtggtttcttcataacagtatgaaaatggactaatatgcatagtatggttttgtgaaactttgcttcatatatatatatatatatatatatatatatgttgggtatatgtggattagcttgctatgtctttgaaaagccacattaattttttttcataagaaaaccacatttaatttgaaacatttcctcactggggtaatcctgattaaaaacaaccttttctgtgaatctaaaataaaataaactaattaatatgaaaacacatagcttaactcttcatgtagtttactcatgaaaaacaataccaaaatcattaatatcacatagatacccacacactcatatatatgcacacatataatatattatgtaagtgtatattatatatgcagcacatattatataatacataattatataatagaccttatataataaatgcatattagatattcatttattgtacacacataaatatatcatatatattagtattaaatgggaacaagtaaaactgaaatataaatcactaatcatacagaatattctataggaacatggtcaacagcattcaagtaactacttagacttcagttttgctgaattgagaatgcaggctaagaacagaagctggattactaagtaatttttttaaaaaaatattgttttcagcatggtagggagaaaagatagcagcaaggtaaaaaaaatctggaaagaatagctagtttctgtttttgtttatttattttattttatttttatagctttatcaagccataattgacatagagtcatgcactccttaaacatggggatatattctgagaaacgtatggttaggtgatttgttcactgaacatcctagaatgcacttacataaacctagatggtatatcctactgcatatctaggttacatggtatagcctattgcttctaggctaccaacttatacagtatgttactctactgaatactataggcaattataacaaaatggtaagtaataatggtttggctgtgtacccacccaaatctcatcttgaattacagctcccataattcccacttgttgtgggagaggcacagtgggagatcattgaatcatgggggcagtttctcccatactgttctcatggtagtgaataagtctcatgagatctgatgtttttataagtggtttcccctttcacttggctttcattctctttcctgctgccatgaaagacatgcctttcatcttccaccatgattgtgaggccttcccagccacgtggaactgtgagtccatgttacctgtgttttctttataaattacccagcctcaggtatatctttatcagcagcatgaaaatgaactaatacagtaagtagttgtgtatctaaaaatatctaaacatagaaaaggtccagtaaaaattcactatgaaagataaaaaatggtacacctgtatagggcaattaccatgagtgcaggctgcaggactggtgttactttggatgagtctgtgagtgatgagtgaatgtgaaggcctaggacatcactattactcagctttagactttataaatgctgtatatttagtctacactaaatgtataaaaaaactacaatgttacagtggctacaaagtcactaggctataggaatttttgagctccactataatcttatgggatcaacttcatatatgtggtgagtcattgactgaaacattacattatgcataactgtgtattaaattgcacatattttaagagtaccactggataggtgttgagatacacacatgcacacacacatgaaaccatcaccaccatcaaggtaattgaagtaatcatcagctccaaagtttccttgtactcctttgtaattcctctttccctttcttttgccaatgtaacagtattgatttttttataattacatataaataaaagtataaattatgtatattttggcttctttcacttaacataattattgggaggctaatttacacttgtgtagaaatatccagctcatatattttacttctgagtagtattccattgtatttctttacctgatgatagatatttgggttgtttccattttctgggtattacaaataaaattgttatgaaccttcctatataagctgtgttagttttccagggatgctataacaaaatactgcagactgaatgctttgaataacagaaatgtatttccttacagttctggagtctagaagctcaagaccatggtgggagcagttgtgattttttctgaggcctatttcctcaacttggggacagttatctttttgctgtgtcctcacatggactttcttctgtgtgtgcacctcactggcatcaccctatgtgctcagtgtcctcatagaacacaacagtcaaatttaagtaggatctaccctaatgccttcattttaccttgtctccaaatacagtcagactctaaggtattgggggttatagttttaacatacgcattttggggagtcacaacacaacctataacataaccatttatgaccatttgcattatttcttacacttatacatacatataggaatggaaagcctgggcttaatggtagacgtatatatgtacataactgttcattaaactgctaatctgtattccaacgtggcatattatttccaccagcatcccactgtctacttattatatcaattagtaagagacaggagtagaaatgttcaatgcaaaatttggctttgtcattgtttccctgcagttctaacagatgttgtttcattattgttaacatggtatataatttcatatccttttattacaatctatttgtcttggtattcaccttcatttttgaaagatatttttacagactatggtttatagattgacattttttttttcttttcaggattctaaaaatgcttcttggcagtctcctaccttgtattgttccagatgagacatctgctgttgtctttgactgctttattcagactgcttttaagttttaacttttatctttggctttgaaaatttttattatgatgtgtcttactgaagttttcttcatgtttttctcatgcttgggatttgttgagcttcttgaatctgcccgtgtgtagagtctgtcgaatctggaaatttgcagccattgtgtcataaaatactttcccttcctctttcaagaatatcaatcacacatagccatttgacattgtcccatagctcatggatgctctgtttattttggcttagtttattttttctctgtgtgtttcatttcagatagtttttattgttctatcttcaacatctctagccttttcttcaaacgtgtttatttttttgttaatctgttaatcctatccagtatatttttcatattagacattgcattcctttttcatatattccatggctctatttatcatgctcataatttatcttcatgtacatttagaatgtaataacattttattgtccttgctattaattctatcatatctgtaactctgaggtctgtttctattatttttttttttactacttaatgggtcacaatttcttgctttttaaaatacctagtaatgtttcattggaatattagacattatacattttacctggttacatgataaatgtctttctgtttcttcagatattcttgaatgttgtgctaggagagaggcacattacttggaagcagtgtgatcctttttggtatggctttttttatttataagctgtgttaagagcagaactcagtagcaggactaattatttcccactactaagtcagactccgtctgaatactccaaccaatgtagaatttttccattctgtgaattaattttccaccctggccagttagaatataaattattcttagtcctatgtgaatgttgagatgatttctctgttcttttcaggttctttccatagcctcaggtagtttccttagatgtctgtgccaatcaacattcaactgcagacttaaggaagactctgcaaatctcatggtctgcccctttgtacagatgttttctcgccagtattctgtgatatgaattctagctgccttagacttaccagtcacctacttttgcctcctaaactcagagataccttcatgcttcacctggattacctctgaaaagtagctcaaaagtatcttcaggctataatccagcataatcacagtgttcacttcatttgtctctcctctctaaaggaacactgttctgataaccaatatatgaaaatgtgttttaactaacttcatttcattttgtagttgtttcagtcagataggaaaatatagactctattactctatcctggcttaaaatgaaaattccccagagatgttccaattatttgaagaaatttttgttgtctttttgcaagccttcctatggtttgaatacttgtgtccctccaaaattcatgctgaaatgtaatctccaatgcaacattattaagaaatgagtccttaggagatgattaggccaggagggctttgtcctcctggattggattagtacctgaagagaattagctaggcccttttgtctttctgtcccttctgccatgcaagtacacagtggccctcactggacactgaacctgctagtacctttatcttggatgttcagcctccagaattgtgaaaaataaatttctgtttatataaattaccctggattctgatattttgttattgcagcacaaatgaactaatacataaattggtaccaagaagttaggtatttctataataaacacctagaaaaatgaaagcagctttggaactgggtgatagctacaggttgaaccataaagtgctatcttggggagagctcagaagaaaaggaaagctgtaaagaaagccagagattaagtggctgtgattagaacattggtgaaaatgtgaagacaattctgataaagtctcaggtgaaaatgagaaacaaagtacagtagtcttttatctgtagatttttttctgcagtttcatttacccatggttaactttggtttggaaatattaaatggaaaattcccttaaaaaaactataagttttaaattggttaccattgtgagtagcataataaaatctcttgccatcctgctccatgttccatcctaccctggatggaatcatcactttctacacagtatccacactacctttgctacctgcctgttagtaacttagtcactctgatttgtctcaaaaattattcacaggcctcaagatttaaagttgttttccttgtggggttttagacttccttgggacctgttactgctttctctattactaattcttccttttgaaataaaaatatttatcatatgtttgttccaccattgagttttggaaatacctaacttgtttgatttcacaggttcacagcagaagagcaaattcctcagaatgaattgtgccttgagccaaacccatatctaatttagatgagactctagactttaggattttgagttggacctggaatgagttaagacttttggagttaatgagatggaatgactgtattttgtacattagaaggatgtaaattttgggggtcaagaggtggaatgttatagttttaatgtttgtgtcccctcccaaattcatgttgagacttaattcctaaggcaatagttttaagaggtggggccttgaggaggttcttaggttatgagagcaagccatcatggttggatcagggccacatgaaatggctgagggaactggatgggtccttttgtccttccatcccttctaccatgtaagaacacagcatttctccctgcagggacatgtcaaaaaaatgccatcttgaaagtacagcctgggcccttactggacaacaagcctgctagcaccctaatttcagcttccagtctccagaacagtaagaaataaatttctcttctgtataaattacccatctaaggtattttgttgtagcagcataaacaaagatggcagtacaatgtaaaatctttcatatcttcccatgaaatcttcagtagaataatcagttaataacaaagtgtgaaacgtattttggcaagacacagacactcttcctcccacttcaataactagaatacagatgtaaacttcaaattaatttgcgtatcaccagaatctacaactatatttggcatatagtaaacacttaataaataattgatgtataatgtaaaggcagccatggctaagaactaaatattcccatacgtatatataaactcaagttttcagtttagtatagatttctaaatataatttgtcattaagttctctggtttagagtaattaagaaaatgttaacactttctatatctacatttggtatacctgtagagttaattataccccaccttccccaggcaggacactgtcgattccctgatgtcattaactacggatacaaacacaatcaagaaggaaaacttgataggcattctgagaaattgctttagccgtagactgttagaaccactctcccatctacttcccacggggcttcaaaaagggaaaagctctgtgtaaggtacaatataggaatagtacatcaagatacaccaaattataaacttttatgactttgtgacaatctaagttacaataatgccgcatataaagcccttttaatatgtatttgatatgatttataagaatacttggctgggcgtggtggctcatgcctgtaatcccagcactttgggaggccgaggtgggcggatcacctgaggtcaggagttcgagaccagcctggacaacagggtgaaaccccatctctactaaaaatatgaaaattagccaggcatggtgataggcacctataagctcagctactcaggagacttaggcaggagaatcgcttgaacctgggaggcggaggttgtagtgagctgagatcgcgttattgcactccagactgggggacaagagcaagactttgtctcaaaaagattaaaaaaagaaaaattcaggccatacgtggtggctcacgcctgtaatcccagcacttttgggaggccaaggcaggcatatcacgaggtcaggagatcgaaaccatcctgggtaacatggtgaaaccctgtctccactaaaaatacaaaaaattagccaggcgtggtggcacgtgcctgtagtcccagctacttgggaggctgaggcaggagaatcacttgaacccaggagacggaggttgcagtgagctgacatcgcgccactgcactccagcctaggcaacagagtgagactccatctcaaaaaaaaaaaaaaaaaaaaaagaatactcagagatttttacctagcaaatacactccttagaattattttataaaaaagaatgaggtattattatgaaatatttaataacagtgataagttaaacttacaagaataacaatgatataatattattaaattattaaaattataatgatgaatgctttgtggccacatggaaatggttatgattaataaagtaaaaatatagagaatacaaaaatcaatctatgatgctatgtgaaaatgtgtgtgaacatgaataaggattggaaaaggaatgcagaataataaaaacacctggtttgttaatgtggctacattgtgaataattctttacaaacacacatatttagagaagaagttgctatgcaaaaggctgtgtgcagatcaagtgtatatgttaaggctaggtttaatgtgggttatatttatagatatggaaaatcagttttcattccttgaaacctctctcaaattaattccttatatataccattagagattaaattttttaggttgcataaaaatatgcacatttgtaacccaagggtgttttaatttgcatctgtgcttgttgcagaagcaacactggtaatttgctactattttgtgcagttagctcttaagggctttggaatctttatttttgctcccactttagaatgccctaatcatgcctgcttgcagtagtttcagaattggctcaatactagtgtagaaaacaagggtgactgatcaagcttcattattgcttacatgagcagacaactgaagtgacagaattaggactaatttaaatgaaacatgtgccttgtctcatgtgaagaaaatgtaaggcttactgacatcatgacagttaaaattatctaagggagttgaagctagatctggaaaaagaaacaacctctatcatggaataaataacccaaatagtggtaaacatatacacaatacacaaccacacacacactatgtatttgtaagagcaaaagaattatctctaatcattaaactcatatctctaaaaatctaaaattaaaaagtaatttcccaaatgtagataagtatactacttgtgcctttatttactaaatcaggaaataaagcaaataggctaaatgatcttatactggagactctcatactagccctctctctctctccttccttctctctctctctctctcacacacacacacacacacacacacagacacacacacacatacagacacacacacacacatacagataatataggcacaatggcacagcctaggagactaaagcaaatgtctttccaattaagataatatatggtaatttaacagtctttgacaaaactcagtgaacacaaagaagctaaagaagtattatacaactgagcatactatcctccactaagaaaactccttttacattgatacttcatgtctataaaaaatttaaatatattaatggcaaataatgtaatatacatgatatatgtatgcatataatttagcatactatgcttcactaagaaagctctatttatgttgatactttatgtccataaaaaatttaaatatattaatggcaaataattcatgtaatatacatgaacgtgtgtgtatatatgtatataatagaaatgtatagatatataatatacatatatacttggaaattatttttatattcaggcaatgcataaaaaatatttccatttacctttttactttcttaacattgaaattccctggccttctcttcttaatgaaatgattcttttgatctcagtaaaataaatatatatttccatgaaaacccttcagagttgtaaaaggttgaataagttcagaattctgagcagccatcaagggcatatcctttgatacagtttgcccttaccatgtaatgtggtgtcccagaaataataaagttaacattgtcctgttaatgcatatagaaagtagacatgaattttagagaactttttcatgcatatttatttgggtttaaggtaaatcctaattattatttttatagaggatttcaagaattgataagtttccataacatacttagaggtgtgcagtgtcataaatatagcaaagtaagacctcaggtcaagtcctacagggcaagcaaaacacacatcttctcagctactagcttttctattggacacaccctaaaagtgactaatttcatcagtgaacaccttgagcactttctacatgctgagctttcggtgtgtaaaattagaaatatctccaatatattctcatttggtctatttgctttctgttatcccatatcttgattatttgagaaatgcttttcctattagattttcgaagatattaatgtagtcattaggtgcctatagcagatattcttgaggtcactccttgatacctgtgtgatctttcacaagttacttaaaccttctgtgtttcaactacctaatttaggtaactctttaatacagatgtaaagaaaagagtgtgtatgcatagtctagaagagttgctggcacataataaggacttaatattttattgatatttctttccatattgttgttagtgttttgcggaaccgtagatgtgtgaactgactgttaatatggtgtgtgatatataaatcatgtagggaggtagaagagctcatagcagtaacaactaacagacaaggtagatggagtgatgagaagtggtggtggcagagaaggctttctaggagaggtgacttttgagataaacattaaagataactagaagttagtaaggtaaatgaggcagaaagagagagacttctaaaaagtaaggtcacaaagtctcttagttaagtgagatatatcatatgataatacggtatttgtatgataattgaattgaaagtttagtatggccgggaaaacactgtagaatagaaaaaaggaaagtgtcaaggaaacaataaggctatatcataaattactatgaaatttatgtaacttgtaaattagcacactggggaatccctgaatgactaaaattggttatactgtcagttatgaattttagaacgcaagttttttttgaaattttattgtccttaagttgaagtgtagtgtctatggtaattctgtttaccctgaaccatttcttccatccttaagtgtatcatggaattttaaaagtgtatgaaaacaactggttacctggaattgagcaatctctcagcctagcaattatcttttcaaaattatgagaaaatttcatcagttcactaaattactaatattgatatttgaggaattagagtaaaagttgtagaagatgagaaaatgacaaatattaatttcaaagaaagaaaacaaaatatcagatatagtcttaaaatcaatctcaagattggttctagaactattgtctaattgtccaacagtttcttcctgcctgctgcacagacaaaaccaattcactgagaccatggtattgtagttaaaaaagagtttaattaatggtaggctggtcatgcagaagaaggagttttactcaaatcagtctccccaaaggctcagatgtcagggtttttcaagcatagcctaattgtcaggagactagggaaagggtgctgctgattggttggggatggaatactaagggtgtggaaaacagtcctcatgcacttattccacctctgggtggtgccacagaaccagttgagtcacgagttgtgagttgtggtaatgtcagtctgaaaaatatttcaaaagaccaatcttaggttctacaacagtggtctcatctataggagcaactggggaagtcaccaatcttgtgacctctggccacatggctcctgaacagtaagggattgtagaaattctgcctacatcttagcagaacttagattccttgcataattctaattttgtttactttcattaatcttacagaggtggtttcagcccccatataaggaggggattagttttagggaggaactgttatccttgattccaagttaaaccataagctaaattcctcccttagttagtttggtctacacctaggaatgataaagaaagccagcctgtgaggctggaagaaaggtggagttagaatattagattttctcacagtcataatctttcaaaggtggtttcatttgttcaaataatattaaaatgaccataaagaacaatgattcactggtaacttgcacaactgctttaagagtaagttataacagattgaactcaattatttcttaaatttaagagattggaaaatgatgaaagtgtcagaggctttcacaccagcgggattccatcttgcatagggtctgggtaaaatgagactgacacttgctgggctgcattcataggagattaggcattcttacaagatgagaaagaaggtcagtaggactggtttcataagacacaggtcataagatacaggtctgctgataaaacgtgatggtaaagaagttggccaaaacccctcaaatccaagatagctatgaaagtggcctctgatcatcctcactgctgattatactgtaattatagtacattagtacactaaaagacactcctatcagtgccatgaaagtttacaaacgccatggcaatatccagaagtcacactatggggtccaaaaaggggagaaaccccaaacctcagctccaggaactctccaatcttttcctggaagactcatgaataatccactccttgtttagcatatgatgaataaataatagtaaaaatgcccaataagcagcccttagggcttttctgcctatgaaatagtcatccttcattttttttattttccaataaactcgctttcacgttactctgtggacttccctgaattctttcttgtgcaagatccaataaccctctcttggggtctggatcaggatccctttctggtaacaaaaatacagtgtccttttgtatttggtattcacaacattgtatttatcataaagatatttgacaaattcttacagaaacattgtaagcatatagcacatgttaactaacataaggacattcagatagaataattatcagaaggacaatattgaaaactatctaaattatgtacaattttattctttgggaaagcctctcatagcatttagtcaatttatagtcttagcctagttcttaatatttcttacctataacctgaattaaattcgagaaagcacatcaatcatacatatgaatgtatattgatgacaaaatatttttataaaaacctaaatgcatgaaataataatgttatgacagccaaactggctaaggtgaaacaataaattgaaactagtaaaggtaatatagagaaggtaaagtttagcactaacctcaattatataagtacacagggagtctgggtttagcaattatacctgtgaagtagtggggattcagtttggaattttagtgatagtcaaaacaatatgagtagactatgtattataactggtaaaaatcgtgcatgttatacgactactttgaatgagggtagagataattttacaattattataatgtcaataatgcccaagacttgtataagtgtataacagattagaatatgccacccaaattgtgcctatttgcataagaactattataagctgattatgttgggaagctgtagacacagaagaagctttaaaaacaaagttacccttttgtagggaaatttacatctatgaagaaaatgtccatttttaagtgggtctatctctctgttttccaagaagactcactagagaagatttaatagatactgtaatcaatggaaaaggcattgacttaaatctgcatatcaaactctaccttttttacctgctttttggtcatcttcccataattggcccccctcaacattcctgttactttgttttatttgagatgctatttaagcctgagttcaaagctatctctttaagatttactaattcttctacatttcttccacatctacatgaggtatacatgttagtaaaattttgctcatatttctcttattagtctgtcttttgtcatagggcaccccagctaagaattcagaatgagttaaaagaaaattactttccttcctctataagtgctataataaaatgaatttatttaattttagctacaatcttgtgatgtaaatattatttatcaattttataggtgaagaaacaggtgcagagagattaaataattgcccaaggtcacatatgtagtaaagaacagagtgatatggctccaaagctaatactctcaagcaagacactgcattttttaaaggtaaaatgaccattcagaaatgatttgttatggtgataacaatgctatatgaggaatggatagttgaaatagaaataaaagtttatagaagaaattactgaagttcatggtaattgacttcaaattatttgaatagttctcttgtgaaaagaagctggacttgtttctgtggcttcaagagggagactaggatccaaaagaattttattttcctgccaggtgaggtggctcacacctgtaatcccagcactttgggagcccaaggtaggcaaatcacctgacgtcaggagttcaagaccagcctggccaacacagcaaagccccatctcttctaaatatacaaaaattagccagacgtggtgatacgtgcctgtagtcccaactactagggagactgaggcaggagaatcgtttgaacccaagaggcagaggttgcagtgagctaagattgtgccactgtactccagcctgggtgacagagtgagactgtgtctcaaaaaaaaaaaaaaaaaaccagaattttatttttatcaacagaaaaatggataaagaaaatgtgatacatatatacaatgaaatattatttagccataaaaaagaacaaaatcttttatggctaaatattatttggccatattctacgtgtaacatacaatatgtgtaacatattgtaacataaaaagattttaaatactttttaatgcaatacttgtctaagataaattttggttaatgatatataaaattgtagaattgcagagttccaggaatgaaatgtagataaatgtgtcttcaataatagtgacaatattttgtagtatatttaacatttgtgaacatctgcaattgctctccttaaccagtaaatgggcaatgattggtggccatccattacagatttaaaaccttaacccatttatgcctgaggttgcaattttttgaaattttgccatcaaaccttggagatgaccttgagcagtaggatataaataactttcacatgcttggcattccaataatggaatactaggcataattaataccagcaaacaatccatttcaaaagaaagattaatgtgctcacaaagccaattagcgtgctctaagtataacatttacacatatctatatttaattttccttgatgtatcttcaattcatctaatgaaaagagagtaaatactctttttttaattaaaaaatatcaccaggcaaaacatttcttattttattatatttcttattttattgaattaccattaagtcattacccctaaacagaaaattattttctgttttctacattttcctctctttttcaagtattctgcatttagtaacatatttaggctgcacatttttctcaacctatctggataattaactatacaccctagatttttaactctcattttgacctactatatgtggtagtatattgatacactataaacattatcaaattcacaaattagtctcattatgtcttttactttctgagtattttcttttgtttgattctctacttttctttatgttacacttttcaatcaaattcattcataatttaaattgatttttttcaaatttaggtgtatttttctattaggtaatttaatagacgatttattgatattaaaattgtaccgtggcataccataaggctcttgagttcattttttcagagtagagaaattgaatatagaaatgagtgaaaaaatctacctgattttcatagaaaattgctcacagaaagaaagtgaactttctttaaaacatgtataaaatgaaacgtacatcttatgttgtaacccaagttcatttgggccactttgaaatgtgtttccatccatcaaagttaaaaaaaaatgggcaaaaagcatttaatactttcaaattgtatccaaaatccatgaagaaaaatatatctacattttgattctcctcaatggggaacacaaaggaatgctgcaacaaacaaaaactcaaaacgaatcttctttagatacatttcaccatcccaatacatttcatagcagtaggtgaaatctccagcttcctccccttctctcgtcaatgtaaaccccatggatgtgttgttcaccaattaaaatccttttgtccttgccataccaaattccatcactatcatgagtctaaatccctaccttcacatatcttgctcactaccctactccctggaaaattctgatgaatacaattttttatcttgtatacttctataaggaggtattattggctatttttgtatcctgaaatcaactatgatataactactggttagttaacacagaagtcagcacctgccaaaacacgactgatgaaaatttctaaatggtagggcttactccatatcaaaccagattgccaagagataataacgaagagatttaaaattaaactaaacaaaagggtttttttctttgaaaacttggcctaatcgtaaggaatatttcttgtgtcaatatattctccattctttctgcagaatcacaataagtaatattgatgaaatttgctgccaagcttcagagtttgtttgtttacatgtttacttatttttcctggaaccccccacctcctttaattaattaattttgagacaaggtctcattctgctgcccaggttgcagtgcagtggcccaatcatagctcactgcaaccttgaactcccaggctcaagcaatcctcccaccacagcctcctgagtagctagaactcttggtgcacattttgttttccttttttttttttctttatagaagagacttcactttgttgattaggctcttctcaaacttctaggctcaagtaatcctcatgtcttagcctcccaaactgctaggattacaggagtgagccactgcacctggcctgcctagaacgttggatttacagatgatcttatccttacttcagagccgttcaaaaaacaaagctgttataaataaacagcaattatgcatagggtatctttcaataaagagacgtaaagtgatgataataatcttgaacattattgaactcctcttgtcttcaatattatatttcaaatgctagaggcaatatagacacaatcctatggttagggtacttgaaaaacagtgaagataaactaaacagtatgtagaaaattataattaaacctaacatatgagtagcctagacccaaaactatatagcttcaaaaagagtcaaagtttatctatatcaagtttgtaaatcaagcaagcatcagaacattattcacttgagataaaacttgaagaagaaatattatttgcataggtaggaattataggaaatatattttagaagagagaaacacaatttactactcataatctgatgatgattaaaattcaggttcacctcttgcaaatatgtatgaactatcctagggctttgatgagatgctaaaggataatgataaatacattacacaaaaagagtccaacaatatggttgttacagtgaagattttgggcattagtaaaatcttataaaatctactttctaaaaatttttcagcaacaacctagtattaactgcataagttttgcattgcttctttgttaacctagcaattttactgctgatttttaccctcaaaatgtaagcattatattgataatatctagcaaatattaataattatgtactacacattggcatttattatcaaacccaatcttcacaaaacccctggagctagattctatccctgtgttacaggcatataaacagagactccaacagcttgagtaatttgaccccccaaaatagagctaacataatgtagagcctacttacaacattcagtctgattttacaagttatgttctgaacaatcaaggaatgatttaagcttctctgagtaggcatatatcaagtttattaggaaacacaaacactaccaatgaaaagcctattcaaatacatgttaaaactaatttaaatattataaatattaatacttgatttatccatcaaatcctttggaaattataagctaattttatctcaactgttactttaggtacttgtcaccttagcataatcaaataagactaagagaacaatcaggtagttcttaggctgatcttgttatttctgaacaatatgatggttcagttctatgtgaaggtcaaaataatataaaaattgaccaatagtgtgtaaaccttgtcatgaaaaaaaattttaaatgtatgctgacagtaaatgtatgctgacatcatgcatggtgagtgactcacaattttgtactacataagaccagaggaaatagagcttagcaagttatttgtcctggagacaactaagtgttcttggaataaccaggcctgagaagaaatagtaacccagggtcactattgattaatttaatttctatcccaaagtttctcagtaagagtctgaacctattgttcatctcactaaatgttattataaccttagcagttcatgttagtatgattcttaatcctaaagtaattgggaaaagtactattaatgatggctggtgttgatcatctgagctgatcccagatagaaagaagctatttcttttggtgggatcaaattccttggggctctgtttggctacaaatgattaaaaagtgagtttattccctgtctcccaaaatgtctcttccactctgtacctcctccccattccctgtaaaaacagagataacacaattgatagaaagtgattcaagtactccacattagaaagttagaaagtagcataaacgctatatatatggatttctggaattccaaggattgaggaaatgaggaggaggcacctagaaagtgtaagtagagaattataagaagggaattaaaagtaaaggctttagatcatgactagaggtcaattcctatgaagggactgtcagggctcagaagctgacaccccaaagtatggtggcttggcatgctgaatactttaacctgaagatttgaaaggcctgagaaacaaggtccctctgatcttctcctgccctcttgtctctacccctgttttcctcttctccccacaagtgagggaaaccaaaatttaccttccccaaggaaggttgaagctagagctcctctccccacgcaagtcataacggtaacttacagtagtcactctctcccttctcctttttcccttggagactctcattacagagagatcctgccccatgcctgtgaggaagaaatgcaacacagagaagccaagaatctgaacagacaggccttgctgtgtttctcagtctgttaccatcagcatatccttagtccaatcacattttctacatggctgtccattcttaattgaacttaagcataaaagtagacagcttttggctgggcacagtggcgcatgcctgtaatcccagcactttcagagtctgaggtgtgaggattgcttgagtctaggagtttgagaccagcctgggcaacatcgtaagacactgtctctacaaaaaaaatttaaaaattagctgggcatggtacatgcctgtagtcccaactactcaagaggccgaggcagaaggatcccttgaaccaaggaagcaaggctgcagtgacccacattcatatcactgcagtccagcctgggccacagagtgagatcttgtctccaaaaaaatttttttaaagacagttttccctgagtcctttggtctcccagtccttcagtctcttctgaagtcttctctgtcacatgaaactttgattaagtaattttgtaagagttttttcttgttatcctgacttttgttataggagtattagccatgacccttatgatgggtaagtaaaagtatcacaccctttccaccctcccagggctttgaccaacattatatgacctatatgttaggctaaaccacgtgtaaaaatgaagatattagagtattttttgacctacaaaatgggcaattttatattcttcactctaataaattaatgtttaacattagatttgcaataactaatttcatgccttaggtatattatggtatctatatacaatttgtgaatcttagtaaacttttaagaaattgaaaagagatatggactctcaataaaaagggatagaagtttgatatacacatatattcacatacaaatatttgtgtttatactcagatgtatgcatatatacatatgcataagtatttaatatgtagtatagatgctccttgacttacaatgaggttagagccttgataaatccactgtaaattgaaaataccacaagttgaaaatttatttattacacctaagagaatgaacatcataacttagcctagccttgttatatgtgctcaaaatacttacattagcctacagttgggcaaaatcatctggcaacacgttacaccatagagtactgattatttaccctgatgatcaggtgactgactagaagctgtggctaactactactacctagcatcaaaagtgactattgcacagcatattgctagcctgggaatagagaaaattcaaaattcaaagtaaagtctttactgaatgtatatcatttcacaccatcatcaaattggaaaattgttaagttgaagcattgtaagtcagggatcatacctatgtctcacatataaataggatatttatggtttaaaaataataataaagtgaacacacttttaccatctcacaacaaacaggacatgccttatttgaatagaattaaaagttgacactaggtggcgttaggccttagagtcatgtgatttaaaataacataaggcaaaattcaacctggggtttgaagtagaggcctatttttaaaatcctctgtggaatttctttctcttgtcatttttgacaagtaggaagaagaaatttgggagaatatcttgttgtcttatgctcaaatgcaatgccctgtattttttttttaaatgaagtgcaatcttggaaatgtgctttagtcttgccctagctaaagaagggcatcaagggaagtgttaagggagaggctgcacccacgggtactatgcaggggatacactgtagctttctgtcaagtcaaataagtaaggagacaaaaacttgaaacatgtaggtaccaagcaagagcaaaatacagccagaaattcattaggcacacaggattgagaaaaaaaaaatatgacatatatctggaaaagtacaactccagagggaaaatatgtgagttaatattttatttatatctgattttgtacttttctctactgaattttcccactagacataactctgaaaattcaaaataaatctgtatttgaattatttagcaggagtgagagagtcagtttcaatatcattttcaagatgctaagttagtaattatattaatagataatgaatcagtgctatgattatctccattataaaggtaggaaaactgaagctcagaaaactttcaacaaagccacatggataaaatgtggtgaagctgaatttttaagccaagctattaaacttccgtgttgtgttcataatcactgttttataacacattattgtaactaccgctttgatgtgcctgtgtaatgcatcatatttttctcatatgcatatcatatatatttatcatgaaattttatcaggaaatttacatagtaaaacttgccatccctagagttatcaagcaataatctataatttcctgaaaaactttttatttttcattttactttaagtttcaggatacatgtgcagaatatgcaggtttactacatagatatacgtgtgctatggtggtttgctgcacctattaatcagtcatctaagttccctgcactcgccccccagcccccaacaggccccaatgtgtgatgttcccctccctgtgtccatgtgttctcattgttcaactcctacttatgagtgagaacatgtggtgttcggttttctgtccctgtgttagtttgctgagaattatggtttccagcttcatccgtgtccctgcagaggacatgaactcatccttttttaaggctgcatagtattccatggggtgtatgtgccatatttgctttatccagtctatcattgatgggcatttgggttcattccaagtctttgctattgtgaagagtgctgcaataaacatatgtgtccatgtatctttatggtagaatgattcataattctttgggtatatagccagtaacaggattgctgggtcaaatggtacttctggttctagatccttgaggaatcaccacactgccttccaaatgtttgaactaatttatactcccaccaacagtgtaaaagcattcctatttctccacagcctcaccagcatctatatttttctggcctttttagtgattgctattctgactggagtgtgatggtatctcattgtggttttatttccatttctctaatgatcagtgatgttgagctttttttcatatgttttttggccgcataaatgtcttcttttgagaagtgtctgtttatatcctttgcccactttttgatgttttttttttttcttgtacatttttttaagttccttatagattctggatataagaactttttcacctgggtagattgcaaaattttttttccccacgctgtaggttgcctgttcactctaactatagattcttttgctgtgcagaagctctttagtttaattagatctcatttgtcaattttgccttttgttgcaattgcttttggcatttttgtcataaagtctttgcccgtgcctgtgtgctaaatggtattgcctaggttttcttctaggatttttatggtttggggttttacattacaatttttaattcatctcgagttaatttttgtataaggtataaggaaggggtccagtttcagttttctgcatatgactagccagttttcccagcaccatttactgaataggaaatcctttcaccattgcttgcttttgtcaggtttgtcgaagatcagatggttgcaaatgtatgatgttatttctgaggtctcttttctgttcccttggtctatatgtctgttttggtactagtaccacactgttttggtttgttttggttattatagccttgtagtatagtttgaagtcaggtagcatgatgcctccagtagagtgggctgctgctatagataccccaaaatatggaagtgactttggaactgggtaacaagcagggattggaacagttcggagggctcagaagaagacaagacgtgggaaagtttggaacttcctagagactcattaaatggctttggccaaaaggttgatagtgatatggacaataaagcccaggctgaggtggtctcagatgaaaatgaggaaatttctgggaactggagcaaaggtgactcttgttatgttttagcaaagagactggcagcattttgcccctgccctagagatttgtggaattttgaacttcagagagatgatttagggcatctggcagaagaaatttctaagcagcaaagcattcaagatgtgacttgggtgctgttaaaggtattcagttttataagggaagcagagcattaagttcagaaaatttgcagcctgacaatgtgataggacagaaaatcccattttctaaggagaaattcaagccagccacggaaatttgcgtaagtaacaaggagcccaaatgtttatccccaggatcatggggaaaatgtttccagggcatgtcagaaatcttcacagcagccctcccaacacacacctgagacctaggcagaaaaagtggtttcttgggccgggaccaggatccccatgctgtgtgcagcctagggacttggtgccctgcaacccagccactctggccatggctgaaagtggccaacatagagcttgggctgtgccttcagagggtgcaagccccaagcattgtcagcttccctgtggtgttgtgccttcaagtgcgtagaattgggatttgggaacctctgccgagatttcagaagatgtatggaaacacctggatgcccaggcagaagtttgctgcaggggtggggccttcatgaagaacctctgttagagcagtgtagaagggatatgtggggtcagagcccccacacagagtccctactcggcaccaccttatggagctgtgagaagagggccactctcctccagaccccagaatggtaaatacactgacagcttgcactgtgtgcctggaaaaaccacacacactaaatgccaggacatgaaagcagccagaaggcaggaggctacatcctgcaaagccacaggggcagagctgcccaagtccatgggaacctacctcttgtatcagcatgacctggatgtgagacatggagtcaaaggaggtcatttttgagctttaagatttgactcccctgctggattttggacttgcatggggcctgtagcccctttgttttggccaacttctcccatttgaaatggctgtatttacccattgaaatgggtaatttatttactcagatgaaacaatggactatggacttttgagctaatgctgaaatgagttataactttgggggaatgttgggaaagcatgattggttttgaaatgtgaggaaatgccatttgggaggggccaggggaggaatgatatggtttggctgtttccccacacaaatctcatcttgcattctcacatcttgtgggagggacccagtagtaggaggtggttgaatcataggggcaggtctttcccatgctgttctcatgatggaggataagtctcacaggatctgatggttttaaaaaggggagttcccctgcacaagctctctttgcctgctgccctccatgtaagatgtgacttgctcctccttgtcttctgccatgattgtgaggcctcctctgccacatggaactgtgggttctccattaaacctcgttcctttgtaaattgcccagtctctggtatgcctttatcagcagcatgaaagcagactaatacacaaagcatagcatttcttggagatctgttatgaaaattggcttactgaaggccttaataaactctgcagtaaatatatctgtgtaactttttttgtatcagcatttcccatgattacttcagtagaaaataccattttttttaaatgacacatcacatttcaaaaaatagtgctttaaaggtattaaatagattactggatttagaaaatgtcccctaagcattttacagttcagggaatgtctggtaagattgcttgacatatggaatactaagtaggagttattagactcatctatctagttataaatttagcttctagctatttttctctattttgaaaatcatgaattaaaaataaataaatttcattgaaattggttaccactttttcaaactctttttcaatttctacccagtgttgtttgtgcagagatatttttaaaattaggtaatacatacagtacatgtttatataaaccatcattgcaaattagaaattctgagatgaccaacaagatgtttatgttcatatctgttgccattttagtcagtttttcaaggatcctggcaatattcaaatctctctttatcctttcagttttaaactggattggtctctggtcaggtgaatgacaaatgaatatatttgaatgttaaatagaaaggaaaggaaatcccctcaggataataatactgttttagttttctcatagtaatttacaaaagaacattaactagttccagttgcctgctccaaactattatggcaattcaaatcttccccaataaaattttaaaagaaaaaaaaaacaattctaattcctagtaataatcatttgtaaaataataaagctccacaatatttttgtaagtttctatttcttgctttgaagtcccaatttactttcatttcgtttgcattttacattctattggacatgattttgaaagatactttgtagtgaatgcatgctcagcatggatacttatttgtgaatatgttgtttaatcaatagtattgaccactgtctttttaagaatgctagtttcttgcataaaaagcattattaccaaccaatgggcataatttgtcttcaacaacattaatgtaatgtaacaatgataactgaattcatataaatatattgttccacttactgagtagatggatgtaattatctgaggaaaagttcttttctcaaccttagaaatagaggtaattgaaaaaagagaaaagctgggcatgtatactgtatataaccaaacattttactttaatgggtcaataaaaagtaaatagacataaacttgaaactgaaaaccatcttggcctttcaaataattactaattttatacacacagggtcacagacataattaaaacatggttgatcagaagatgagatttctggtttttatcccatgatttttcattaaaatattagtaatgtcttacatacctcaggcacttttcatttaaaagacagcggctatgataaaaattttgaccttctcaacatgtctcttagggataaatggcaaaagttagatcagctaggtgaggagatatttaaaatcactcgacttatttatcagtggagctgaaaataaaactgatgtctttttacaaacttgctttataatattatgccttattgaaatatattctagctgaaaagcaactaagtagggcatactgtttccaaaggtgcttttagtatatatttaaaatattaaataattgatacattagaaactcaaaactattatttgagtttacaaataagacaacggctaacatattttatataatatctttcagtttgtaacatgctttctcatattatttccccaaaattaaaatgcctacttgattgatgcaaatgtttctatgatgataatatttaactatatttaaaagaaaaaataaagaattttttaaaaatcactctataatataaacctcttgaaggaaaatgtattattaaatattttaccaaccctgtactacttatttctgagaaatccatcttcacttctatggaaaatatgtttctccaccacactgccatttgatcaatgtgtaaacagcaattgtcttaagtgaaaatgtcctcttgatcataactactggtcaaaacatgaacacttgatccaagctgaggcaataacttcgtaacgaaggatacgaggatgagcatgcagctcaagtcagttgacctaaagttttcaggacagaaaaccagacccgccctcagcaacatcctcttatacctgagaatccagtgaaaaagggtgaagttgatcgggcgcagcggctgacgtctgtaatcccagcactttgggaggccgaggcgggcagatcacaaggtcaggagattgagaccagcctggctaacacagtgaaaccctgtctctactaaaaatacaaaaaaaaattagccgggcgtggtggcaggcgcttgtagtcccagctactcgggaggctgaggcaggagaatggcatgaacctggaaggtggagcttgcagtgagcagagatcaggccactgcactccagcctgggcgacagagtgatcctccatctcaagaaaaaaaaaaaaaaagtgaagtcaacatgaagataagcaaaaataatagatggagagatttccttgctagcttttgggtctctggtttgctttactatttaatttatttatattttagagataagggtctcacagacttatcacacgaccttattttcaatactaaaagataatgtttgctgctctttatagaattggttgaaaatagtccaagtaagtcagggaagttggaatagcagaaactccaccaagatggtgatcttggtgtagtattgatagatcttgactgtagtattgtaaaggaagaattatggtggcttagcatggtgtacagacactgaatataaagaaaaccagatgcatatgagattggtttgagatacgactgaaaggacttggggacagattgaatatgggggtcgatgagggaaatagaagaattcaaagaaattttcaggctaaacaaacaattaaagacctcaaagtcagaagaataaataaagatctgaagctgagttgcttatagccaaatttgattagccatagaactgaaagcttctgaggttgggtgtgagagtacaggtaggtcatctgctatatgcaatatgagaaatgcaactgcaatatctacattaagccacaaatcatgaatacctgcttgactatgtcctctgtaatggaattatgaaacattctgtcgactctcttaagaaaacatcaggaaatcttgtagaaatagagggatcccttttgtttggatgacttagactttatttccagaggtatcttgtatttaacaaaatggatattggacagctactcaaattcacactgaatttgagtagctgatgaatgaactagaggtaaaaaagtagtaatacgcaacacacaacacatttcatgagttttgctgtgaaaaaacacaagtgaggtagagcctcttaagacaccagataacaagaacatgctgagatatctctggaaatggtgctaaaaagagaggaattagtaatacagaaatgagaaaatctacagtgaaaatatatttattttttgttactgaataaaataaattttactttaatgacacgaaaagatcaaccatccctcatccaacaaattaaaaagtcagaaattatcatttacagcaatgacaaaaagtgtttctgatttatagttattctgaaaataacattttttcaaacacttttcacctgaaatctaaccagactcctgtacataattttgatgttattaaaatttacattcacttgaaagaagcaaagttttaaacccagatgtcaaaaacatgacaccaaatcccacagagaatccatggatgttgagtctcttcaaaatttaaaattatgtagctttttaaaaaatgatgttttccctttactcataagaatattttattaccgcaacctggcttcaccttaatctttgtcattcctaattaatgtcctaattaatgactctctgtcatttctaatcaatgtagaatgtgtacaacaaatttcagtttcacaaagacaaatccataaaagcaagtgcaggtgtttaaaccatgaatttggggcagttactttcagatgtcaaaaatagcagcctagtatctgcaaagcagttgcctgatataaagaattcttaagaagatgcagttttataacagtaatgaaaaaaatactatatctagaaaatataaagtatatatttctaggtatagtctataaatacagtaaacttttgtgatctccgtgagttctgagaaacttgttgatagttttattttcagattatagaagtttacattataaaatttattataaattttggttataactattattataactagcataaaagattagtatctttgtcagacaatgttattataaaccaagtgtatttataaaacatatgtgtatatatgtatatgtgtgtgtataaaatacctataacttcatatacaatagccatttacttgggatgcattaatattttgttagaagaaacacaacctaatctacaaccattacataggtttttgctatttgcgcttcttctactgcctttctagatctttactttgattacatttctacagattatatgtgataaattatcagtgttccaacataaattaatcatttagaaacaaaatagtaatatcataattacattaaagtttatatcttctttcagagatctaagaaaacctaaggtttggtgtttctttaatgactaaacatctaaagatataagaatgtaggtagttatcgtaggttttatgattattgtatattctggggaagaggtttagaaattagtttaggccgggcacggtggctcacgtttgtaatcccagcactttgggaggccgaggcgggcggatcacgaagtcaggagatagagaccatcctggctaacacggtgaaaccctgtctctactaaaaataccaaaaattagccaagtgtggtcatgggcgcctgtagtcccaactactcgggaggctgaggcaggagaatggcgtgaacccgggagtcggagtttgcagtgagtagagatcgcatcactgcactccagcctggacgacagagcgagactacgacagagcgagactccgtctcaaaaaaaaaaaaaaagaaggaaaaaaattatcttactttagaatatcataaaatcatcatgaagattttaaaaattttggtctggtatattgtatgaatcccagggattaagagaggcaattttgcccataacaacttctaatattctcggtgctaaatggtgtcagtgaaactggtccaactgtcccgtagaactgatgtttatagtttcttccgaataaacatataaattaaccctcccccccacgccccaaacacacacacacactctagtctcaaacttaagaaagttacgtttgtcttattgagttcctttctcaggaaaccaccaatggggggcttcacagagactaccaaagaactgaaacttaacaggttactgcatctggacgatgagatactagattccccacccatcatgactgtcttacctaccacctgttgtctgttgacaaactcctcttccttacatctccctaattcctattttctcacacatggttacatttctttcctgttatataaatccctaatttcagttggttgaagagatggatttgagactcatctctcacctccttagctgcaatacctcattaaattcttcttccctagaaatattcattgtctcaatgattggctttctgtgcagtggggagcaggacctatactgaacccctagcatttcagtaacagattttggtttcctggccaggaacacattgctcatggctcagactgcagtgggccaggagtttcagaaaccctcctaaacagtggcttcaccattttttcgccagagcttggtctcattctctcttcggccctgccacttctggccccaaccacacttctgattgcctaggaagaatagcctttgacatttgacatctgagtttggatggctgagtgtcttttgtaggtaccagatagctggatatgccgtcctcaatttggggaatgctgaaggaatttccatttgaaggttgaacaagcccaaccaattcagagaggaaaacaccctggctgtttcactttggatacttggggctagtttgttgctcagtatgtggattgtgttttggttattgtttgtgtgtatgttgatgtagtcacgggaggtcagtgttctatcccagaatacagccctttggggtgccttcttcatggttggtctgtatgggcttgtgagccaggccctgaatgtgtctatctcatctgatctttgaaggtctttaaatggtactgttgtcttacaattggattcattttgctattgaatgggaaagcaggatggagttttgtgaacctaggcttttatgctgctgttctaagcagggtttggtcaggttagtacatgatgttcttctgagatgctgtttggcccgagtgttctttggagtctggggaggtttggcttttaaaaatcaaactgctggctgggcgcggtggctcacacctgtaatcccagcactttgggagcccaaggtaggtggatcatgaggtcaggagttcgagaccagcctggccaacatggtgaaactctgtctgtactaaaaatacaaaaattagccgggtgtagtggcgggcgcctgcaatcctagctactcaggaggccgagacagaagaattgcttgaagcctggaggtggaggttgcagtgagctgagatcgcaccactgcactccagcctgagcaacaaagagcaaaactctagtctcaaaaaaaaaaaaaatcaaactaccttggaaactgctgcacccaaaatattggtacaaaaccttcactggattacctatgggggcaaacaaagtttacccatgtgaccatatttgtaaactggtgagttcatgttgctatctgatggcgagagtttcaaggtaaaaactattggatctttgtgtgtgtatatacatgtttagatgtgtttatcatatgttgcatctaacaaattggcttttaaataaaagagtactaataagtccaggcaattttcaaattcatgtgacttaagtaaatcttaaataaacaagctagctttacaattattggtaaaattaaaataaaagtttcttaggaattgtcagcatacattttcatctgggttttatatttgtctttgctagatattttgaaatatcagagttcggcacagaaggctataaaactataaaagcaaccaaaacaaaatgatctttgtgcaaatttatttgacaaaactaatataatgtttttggtttaataaaaacagctaaatcttcggaattattggcaaaataatccatgtatttaactttaagtttgttactataaaacctaatatttacaggttataaaatggttaacaaggaaatgctgattttgtctaatacttcagttcttataagtaatctagataaactgctaaaaaaaatgaaagattccagtacatgtgaatggtattagtgctggtgaacattttgtagaatataaaaacaaaattattttagacgctcctttgatgtctgggtcatttccaattaagaaagggttatgatatgcagaaatgtattttttaaaattgtagaatgttctcatctataaaatccaataattggtagaagttcaggatttcttgcttcctaggctttcactaaaatgtaagggtacttagaataagaattctagctaatatatcattctgtatataaaatgtgccaaagaagatatgttcttattgaaaaaaacaataattttgtctaattcacaagtcatctaaaggttaattcaaattatggactatggcaaagttttgccataaaataaaatgagtggttacttttaaaaaatatatagaataaaacagaaattccaagtatgtcattgtctgtgtaagtcataaattttttttcctgtttctctgtgtgtctatcttcatggccactccagcatggcacatgtatacatatgtaactaacctgcacattgtgcacatgtatcctgaaacttaaagtataaataataataaaaaaaagaaaaatgtagttgacttctttagcataatagtttggataattctgtcattaaaatacccttctgctttttccagaataaataatcatcacaattaaaaaaaaattgaaaatgtttagataataaaatattctttgaagcccaatagataattggagacatttgactaattaacattgttcatagttaaagctcttagtgtttatgaaggtaaaataagaaatattgtaaagaaatacattggcaatttggcaattctttttttaatattgttaagcatgaagctggatttagcatggagcctaatttcacataaatgcttgctttgttttacttaacactaaatttgctattctgtttattagtaccagcactacaacatttacttgtcaaatgcctgaagaaaatttcttaattgcataaaatgcattgtggtattttgtagacttaaagatattcagttgtatatcaggaacaaaatatccacaacgtgtatgtttttatgtcctggatagcactgtagcctccgatgtaaactgagtaagataaaatgtgggggttgctttcctgtttattttgttttgcttttaatttttattcattttctatcttttcttagtttttatgtatatatgtatatataaagcactttcttgttgtttttttgttttttggtttctaacagaatgctcatatttgactccttgaatagtcattttgtttcctatacatttgaaacaattcatcatttgttctgtttatcaaaagtccctaagttacctttgtcaagcctcccaaaattgataggacaacctagccatttaaaattcaatatgtttttcttacctctgatgacctagagagcttcaagagctttgaggattctggaaataaataaagaaaattttttttttaagttctgaacagggatagtacattatttattttgttatttggaaaagtaggtaggagtagaaatgtttaaatggtatttatgttcaaggtaacttaattcagtccataatttgagttggtttttgatcttttcctttaggtaatgaggaaaaactgatatggttacaaagttttaatgttcaggaaagattggccttgttcttaagataattatgacggctgcgatggtgtgtgtggagtggctgctgtaaggatgctggcttcagtgtgggaggtgcagctggtgctgcgtgcttcagagatggtgggagccaggaacaggtgagagctctgccccctactgagttggcagggcaggacgccacagtactgggttgagcgatatcggggaaaattcagccagatatcgggcgaaattcacccccgatatttcacgtaggttcttttctatattccctaagtgtcggatggtctgagaaataaagggacagaatacaaaagagagaaattttaaagctgggtgtccaggatagacatcacatgttggcaggttccgtgttgccccctgagctgtaaaaccagcaagtttttattagtgatttcaaaaggaaagggaatgtatgaatagggtgtgggtcatagagatcacgtgcttcacaaggtaataagatatcacaaggcaaatggaggcagggcgagatcacaggaccacaggacaggggtgaaattagaattgctaatgaagtttcgggcatgcattgtcattgataacatcttatcaggagacatggtttgagagcagacaaccagtctcactaaaaatttattaggcaggaatttcctcattctaataagcctgggagcgctatgggagactagggcttatttcatccctacagcttcgaccataaaagacggccacctgctgaagcggccattttagaggcctaccctcagggacacattctctttctcagggatgttccttgctgagaaaaagaattcagcgatatttctcccatttgcttttgaaagaagagaaatatggctctgttccgcctggctcactggtggtcagagtttaaggttatctctcttgttccctgaacattgctgttatcttgttcttttttcaaggtgcccagatttcatattgtttaaacacacatgctctacaaacaatttgtgcaggtaacacaatcatcacagggtcctgaggcgacatacgtcctcctcagcttatgaaaatgacgggattaagagactaaagtaaagacaggcataggaaatcacaagggtattgattggggaagtgataagtgtccatgaaatcttcacaatttatgttcagagattgcagtaaagacaggcgtaagaaattataaaagtattaatttggggaatctgataaatgtccatgaaatcttcacaatttatgttcttccaccatggcttcagtcagtccctccatttggggtccctgacttcccacaacagagctgcacctgtccagtcacagtccagactccagcatccctgaactcttggggacccagagtgagaacttcattgatgactgcttggcaaatctgatggtgctttttccaggcccatttgtggtcacccatggacaaattagcatgcacttccttcattcttagcacattaaaaaccccaggctcagctagactcacacactctttgagacgacctgcctgaggaaaggagctacccactatgcaacttctcctctcctctcttctgagagctagacattcacagggacaacttgcctgtggaaaggagctacccactctgggtctcctctctgctgagagctgggcattcattgggatgacctgcctgcagaaagaagctacccacttcgggtctcctgagagctgttctgttgcccagtaaggctcctttcttccttgctcaccttccagttgtctgcatgccttattcttcccggatgcgggacaagaacctgggacatgctgaatggtgggactaaaatagctgtaacacaaacagggctaaaataccccctgctctacacacacacttgccacgttgtgggtgatgagaaggagcaaacagctgaggcccttcatggattccagacctaggggctccccaaggcggggctgtgacatcctcattggggctctgtggttcctaacatctccaagcctctgggcaaggctgtcagtggtatgcctgttccacccacagccttgcacagagctggcacctttgctggcacctggagctgcccaccctgacacagccagtgcccttggctgtgtacagtggtaagacctcatgctcactcactcacacacccctcactgatccctgcctggctcacccttggaaggtgtgggatccaggctggtagcacaatccaagcacagcctgccaggccaagtaggtggaatgagcccagtgagcccaagcaaaactcaggcaaagatgccaccagccacagaggtttctggctggaaaagcaaccccctaaggatcctctgacaattatattgactgggatttctctaaattactgtacttgtatttagcattattaaaattatgtgatattcaaatggattaagtagtaataaaaaatgtgagactttctggtaatttttttgaacccaagatgtttatcactgatgggccttcatgtgtcttcatgaaaacaaaatatgtacaagtgtcacactagcttgaagattctactggtggaagttacctaattagttgttagtactgtacctagaaactgatcttggaaatgtgtgatgatactcttttaaatagcttaaaagaaaatattgtgtggttattcttcctttgtccttgtttcgctgcatagtcttaaagtgcaagattatttacttttaaataatcttttaaatagcttaaaagaaaatattgtgtggttattcttcctttgtccttgttttgctgaatagtcttaaagtgaaagattatttactttcatactgaatttccaaaaacaatatttgcatttaccattttttaatgatgaggaaaagttaattgtgttacttggcaagtttgcattgaacctatcacattttttaatgctttgctcacagtactttcactagagtgctagcaattagatgtatgcaaggagtaaccttaccacattaatacaatgttttgcctagacaccaagtcatagtgttttaatttctgacatgttagagagaatgataggactttcttcagtataaatgtcctattaactgccaaatcttgagcattgacagcagccaaagccttctcttcagaccagggaaaaggtgacaatcaaaatggactactttcaagagactcagggccagaaactaaaactattcagtccctgtaggcccaagtactattatggaagaagtgggcatgtgagattgtaaaagccagttccagggataaaagtagttcagagtttttctataaattaaacattaatagcaaaagtacactgatgcaagccagcatttaggtatttgtgtcagaataacagggttttcttggagcattcatctgaactttaatagcaactttaaaaaagttataaaaggtttatgaaattcttaccttatggtcaaactaatttcaaatgtgaggtggttttaattttccttatttttatatagatgtgttgttaatatgtgttccaggattgtatgagatttctgaaattctgatatgttttaacatatgttgtcagtaatgattatcattattattctaaattttttatatgccacagaaataaccaaattttattgtcaaatgtgtctgtcctaagacttttgttatccacaattgttttgctttgattcttctaaaaagcaacttataattagctacggtccagggcttgcttcttccagggagttcatgaaaaggactctggaatgcagttttctgttaatgtttgagattatgccattagaaagaaaatttctaggacacaaattaaaaggcttatgttttcaaaaagattgctaacccaacatgaggtagatcaggagttgattgcatagaatgaactaatggaggacagaaataatattgaaacattgctgttttttttttttcagagtctagagaatttttttcttttgaagtatttatagcctttaacaactgagtagagcgtacttttgtaaacagaatttaaagcatgtttctctctttgcctgatttctccagaattcagaaactgtgaatattctttattcaggacaatgtggttgtttgcataagttcaataagagtatattttatgttataataggacacaattgtaggaactgattattttctcagggctttcactgaaatgtcgtgttttcagatatgagtagcctgctttgagaaactgctgttaactttatggagctgatgagacccccttagaaggattggcctcataccttatctacacattcctttgcagggtttctggcctgtggttaagttgacaatttcactttctgacaggtccaggaacctcaagtatctcaagttggggcctggagaaaaaggggttcactgaatacatgcaggtatctgcaggtgcagatagattcctggctgggctcgggaggcctttggaggccaagtctgagattccctgtgagaggttccaatgaagctaacttaggagaggtatattgaaaatgatacttgctatattttttgtgagtaatcaggccaagtgtaatgggactgaagtttattttgcaggtaggtttatccagctgtgatttgtctttggtggaagtgggggaatggagagagaaaaattacatttcagaagaaaactatataattatattaaccgttgattcctgggtggacagtggccacccctagtatgaagttgcccacaaagactactcagcataaagcaggcagaaagatccacgatgagatttctcacgattgagaaattggtaaacagcaagaggtggcctgaaactggcccaattgtttcatagaactgatgtttatggtttcttctgaataaacatagaaatttaccctctatgtctcaaaacttacatttgtcttatctgaattcctttctcaggaaatcaaccaccaggcctccagatagtatcaaagaattgaaacctaccagatcacaacatctggagacaccagacccctcacctatcatgattgtcttacccaccatctgtttactgttgatcaactcctctctgtcttaaccctccctaatttctgttttcctgcacttggttacatttcttccctcctatataaaccactaaatttagttcagttgaagagatggatttgagactgaactcctgttttcctcagctgtagcacttgaataaccctcttccctaacaacactcatcttaatgactggttttctgtgcagtgagcaggaagacctacactgaatctctggcattttgataacatcagttataatttctattatctctgtatgctaaggacaataactttgaaatatggggatagttccagtattaaaactagaaaaaaagtggcaaaattttttacatcagaatgggtagtaaaatttgtatagcccctcacaaagaacatactggtgttccaatgatataaaaccttctgggatcgtgaaaaggctgaaatttttagacttgataaaaaatgaataagatagtgttgaaaccatttttagtttctatcaataataatgaatggagcgaggggtgatggtacgttcctgtagtcccagctacgtgaaaagctgaaatggcaggactttttgagcccagaagtttgagacaagtctgggtaatatagtgagaccctgtctctaaataataataataataataatcaatggagcctcttggtagaattgtatttttatcttgtactccaaattgtccattactatgtggccaccaccctccaattcaagaggaattatatttctacataaattatcttccatagcaggttttcacatgttccaagataaattattttaatcaaaaataaggtaaatttgaattcttttagcagataacaactttaagaaatttttaatctcaattttatgtttatcaagatattcattccaagtttcatttagtatctacgtggatacgcatccctcattaattgatttctggagacaaaccattttctgaaagacttatcttttattatctcatagatttgttttttcccagtcacccagctactgcaactgtattttacttctctactttgacttccacatttttttccctctattcttctgtaagttcatttattgttaacacttggtgtcattagcgctaattttattctcttattttctaatgaacaattatagcagcatttctaaagccataatgatgtaataacaaaaaaaataaagatttaatagatatatagggtaagatttttaccaacactttaaaatctagcttggttaccctgaagcaaaaacaaaacaaaacaaaacaatggtaactagagcagaactattttgctctataaatattccattatctgcatcattcagagttgtctgttataaatacttattctatttttattttaattgataaatatttatgtatatttatataaatacaatgtacaatatgatgttttgatctacatatatgttgtagaaagattcaatcagggtaattaacttatccatcaccacacaaatttatcattttttggagtaaagagaatgttaaaaatttatccttttagcaattttcaaatatataatacattcttattaattgtattaatatgcagtataatagatcactcaatttatacctccagtctaactgaaactttatatcctttgatcaatatctctcaagtcctcatcactccttcttctcccaccgccaaccccagccttcggttactacctttctattttctctatttccatgatttattaaaattttcccttaatccattattaagccatccaaatcaaccaccaaaataatatttaatttaaagcacataaaactttaattgtttaaggcttattatagttgttagacatgttttaacttggacatatttaggaaatgcaaggtatacttacaagctaaaaggtagaaggaacattgcattaagagtcaagagaaattatattcctcttggctcatgggggtggatccttcatggcttgataagtctttatgatagtgagttttcaagaggtctggtcatttaaacgtgtatggcacctcaacaaactgtaagagcagcctgaggggctgaaccctgcaaagccgcaggctgggcagagctgcttaaggtctttggagctcacccttataccagtgtgccatggatggaggacatggagataaagtagattattttggagctttaatatttaatgactgccctgttgagtttcaaatttccgtaaggcctgtagcctctttcttttcacctatttctccctttgggaacaggactgtttactcaatgcctatacattccatttcaatgctgtaggtggggcctggtgggaggtgtttgaatcatgggggaagatccttcatggcttagtgctgtctttgtgatattgagttctggtcatgtaaaactgtttagcacctccccccagcacccacaagcatctctctctatgtctctctctcttgctcttgcttttgctatgtgatgtgcttgctcctgtttcatcttccactataatcttaagcctcctcaggactccccagaagcagacaccactatgcttcctgtgcagcctacagaactgagagtcaattacacctcttttctcataaattacccagcttctggtatttcttcatatcaatacagtaacagcctaatactgatactaaaaccaatttgtgaaagatagacaggaaatgagatttccaaggtgcctaactattaccaacagcattatttgctaatttcaaagagaaaacatactttcagaaaatagtgttgtggctgttatcatcttagttaaattctcttaaatagcatatttatatcaggtcaactttgcttcctaaggtaatgtaatacgcagttcccattaaactgataaactaatattgtcaaaatgtttaacatgaatttaacagtatatgaggttggcaaagtttttatctagagggtaggtagtaaatattttaggcatttgggtcacatactatctatattgtatattgttctttttcttgtttgtttgttcctttacatgtaaaactccttcttagtttgaatgttgtttaaaaataaatcacaggctggggttgtcctacaggtcatattttattgacttctggcttgaaggaatacttgaaaaaccctacaagaaagtgatctgacaaatctaaattataatacattctaaaagacagtcaacgcttctttcttcaagatgtaaatggtataaaaatataaataaggggagaggactgtttaaccataaatatgactaaagagataaaactaaatacaaaaacctgcatactatacatgaaattggatcctgcttcaataatattttacaacttataaaagacattttagaatattttcctttatttcaaaggaaatatccattatttcaaaaaatgttagtatttaaagtagtgattacttcccagtatttcttaatattagtaaaacactacatcatctgaagaaataattgccacatatttgaaagtctatgtctgctcgttttaaatagtagttttcaaaatgcctaaagttgcaaatctggactactcaagtcaatagtctacttgagaactggataatttaggcatagatattccactgatatattctggagcaccatgtagataaatctttgaaaaaaaaaacaacattctcagtcttctctttatgtttaactctatgggcacatgtcagtaatgagcttagtatcggtaatcacagagatagcatgtgtaagcagactcttgagatcagctagatcatttcctatgggaatttacaaggatatcttgctcctttcttttctttacttgtatatgaattacttgatacaggtttggataatttaaatgtttgctcaatcctctacacgcctctgttctctcactacagcccaaagaaagatgtacattggtctttgtaagatgagttatgtgattcagccctgctaactgcagtatttgtagggtggcagagtaactatttcaagctcaaagtcattaaaaatgtcatctgatatctaactgacttagggcataatacccccagcaacaagtaaatccgtggactcaaagacaggcaggcctccaattaaccctccccagctactaaaactgaagaactacctttcatatattgtcactgtgttggtgattagtcaaataatttatgaaaaaatatacatagttatttggaataaatgaatgctgaaattactaaacatcaacagctacagtggttactgctgcccattccttgatcttgtttaaaaaacaaaaacaaaaacaaaaacaaaaaaaacctctcatgattcatattagtataaaagatgtttctgatgaattgtcaaccttagatcctccatactcgtctcactccggaagaaaacaataaagacctccagatgtcaaaataattctgtactatccggtaccttgtaaattaatatgtacacaaacacccactcagaactacacataaaacaaagccttcttttaaattctgacagatcttttcaaacttcatgttatccctctagcagtttttaatgtagcatcaaccttaacaaaaacagtcttgtgttgtgaagacaagaattatttcctgaaattttgttttaattgcacgcacagatgtgtgtgtgtgtgtgtgtgtgtttgtgcctttgtgtgtgctaagtggcaatggaaatttgtaattaggatacagtaatgaaaagttcgaaggttataatacttgaaaggataacagcattaacaagactagatactttttctgcttttactaccctaagaagaataagggctttagtaaaagccatctaccaccaacattttaggattataaaatattttattcacgagagttgtagttagagaaaattcatagaagccaccttctatttcacttatcgagactgtaagcaaaattcataattattattatcttttatgatttctttttatgtataatttcaatttttcattaatggccattttatgtctcattattcttcattattctttacaagaattattattatttaggtgttacctgttccaagactaaaagaaatagctatattactaagcatgaaaagaaatctagtttaactttgcaatcgaaaactaaagagcgaaacagaatccttgattaacaaccaaagtttctcattttgtttacagcaaaaatgattaattgtcttctaatgggtaaatcaatactttgcttaatggtatctgtttctcagaactgcatacctctagttcattaactcttctaaatagcatcctgccttggaaaactgcacaaaatgtgctgatgtttcttttaaagtcttgataaatcttctgttctctttgtcttaatcagtctctcactaagtctgcattactaacaatacaagtatagtgttttagtattctgatacagtttacataagtaataggagaaaaaatgagaagactattgttcaaggacttataatagcaataaggctagcaatggaccaatcactcattacagaaacccattatgcaccagcaagtctaataagattgtacaacctgaagtaaaaaactaaaaaaggaagaaataataaataaataaataaatacattgatggagttttccagtatgcagatagactaaggggctattatccattaatttaacaaatatgctgggaggcctgactatgtgattggctaacataagcagcaaagacaggcaaagcccctgagctcatggaaattcctttccagtgggtgatttaaacaatagagaagcccatcaataaattaacgagataaattcatttagaataagtgctataaagataacaaagagggactttgggtaggaggcataatgtaaatttggcttgcagtgaataggtcgctgaggcactgatgtgtcagctgaggcttacttgaatgacaagaagtcagccatgtcattcaggctgaggtggcaacaggtccaaaggccttacacagaaacaatcatggtacaaataaaaacagaaggagggcagtcttaatttcatctaaagaagctgaagtcttattcactacccacataatacttttcaaaggaaataacagaatagttgaaaacataatattgataaaatgattataagtctcttccctgcatttgccatgcataaacaacaacttataaaaaaaaaaggtatttatatcacaatccatctcataatattataccatctctctagtctctggactctttctctttttcaggctgttagcaatagtgcttcccttgttctcttctttcataggaaaacccattcaaataaaacaaaagccagaaatacaagattaatactttcaaccctaaagaatattgctcccttgaatcaacaaaatacaaagaaaatacacaatttttgaagaggaataactgaaagaggataaaaatatatcaagagagtaaacacaaataatctcaaatgattttcttgttacacacacacacatacacgtgcatacacatgcattttagagaactatgatatgattaatgcaggagacagaaaaacatataactacacatactgaaaaaatcgttatatttattaaaagtggacaaagtggagaaattgccagaaaatatataattgagatttcagacataaagaaacatacaaatgaccaaactatcagtgcttctatttctgaaattgagacagaatataagcttaaagcaaagctgcttaagaaattatgaaattaaaatatggaagacatttataatgtcaaatatacttagacgtggaaattagttaattaaagtgctatggagtcttttcttaaacggaaaactaaggtctcttctaattgtggttgtgttactctcaatccctgatacacagatttatatagaaggaattctaggttgtttgacttaagattttacatactttaaattattcatggtttaaaaatgaaaacaattgaaacataagaattaattataagacatttttgttttctttcaatttttcaatttaaacaacacagacacaatacttaggaaataatggggaagaaatagaagtacattaataggtcatgatgtcaataagaggagtggaaagacagaatgcaatttcaaagaaaattttaaacatcgaaatgaaaaagaaaatgaaaaaagggatcaagaaaatgatgaaaagtcatattacagattaactcaaaaaatggcatgatgagtacttgagccactgtgtatgaaaaacatactaatagagacatagcactcaaaactaaggcgagaaatcaattttcaatgcctccagaacatccaaacaatactaaatcttttggtccatttctgacaacaggaagagccaattaaaaattgcctcttgaaaaaccatttctcccttggcacgaagtatatttctgaagccaattttgggaaacacccccattttccttgtaggtcttcatttttctgaaagttactttgtattgtatctcttcctcttttatttaaaaataatcaagttgatacttattaactattttgtttcttgctttattattcatagatatcaaggttatgcttgcagtcaaaaaagatatattaaaaatattgtgtggtcatttaagaactcagtcatataagttttgagtatacagtattgcaatacatataattgttttctaaaatgttcaaaattaagatatttggttataacaatttaaaaattagatattttgaaaaatgataaagatctgttttgccaggttttattgtcaaaaggtaatttagctacctaactgtggccatatctttctcctctataaagccaatgtttcaaaatttgtttttgcttagtaattccatttcttcagctctaatatagttggtagcctacagtgcccagtgaaaacattccacatcaaggtcatcaaatgtcttctgtatttctaaattcaatggtgctttataaaattgtcatcttgagctttcttcagtgtttgtcagagccactcactatttctctctgaaacacttttctttgcttccactaaaccatgtctttttatttattccttctaaatttctgactcctttgaagattcatttacttaacgaccattacattttaacatatgtcaggacagtgcaaggcccctttatctttcctcttcagaatctctccttaaaaaaaggtaccataatgttaacatttacatgggtgtcttttcaatatatgactctagtccagacttttcttttaaactaagtaccaatataaccaactgcctattaatcatctctttgcatgtgtcaaaattacttcaagctcaatatatgctacattaaagacataatttatctccttctgggaatcaaattctctccagagttctcaaatatcatggttgggatactatgcgtttattgcccccaagctgaaacataggaatcatatttgataacttccacttctgtattaaatttgtcactaaatccttttgattttactttcaaactacatcttacaaatccattcatgtattctctgtctacatttcccatctggatgtggccttttgcatgagatgatatgaaactgcaccctaaagggcaattcttcatcatctattagctcctccaacagttctgtgcacagtacctgaaaaaatcttttgaaaatgcaaatgtggatatgtgttgccaatttttcctaagataaaaaacacaattcttatcaaaatctaaaatttctgcaagaattggcacctggttaccacaccaggcaatttgaacctctttttctctctcaattactgtgtttccaccactcagaccatgatttatctcacatcagggcatctgcctttcccttaactcagaatatatcagcaatcctcctcccactccctctgcttagtaaactgcagtacctaccatcaatctcaactcagtgatcctataaataatttcaactctccttgtaatgtgcttccttatatacccatatttttatttaaataaattattaatgtataattaaattgttgtgtgattattcaattaacatctgtcttcctcactaaattgcaagattcatgaagtcaaattcaagacatttgcttaacctgttatccataggaaataaaatagcacttggccccaaataggtacttaaacattttaaaatcagtgaatatgcaaatgaataagaaactgaatgaataaatataaaatttcaaccctagaacagtattcaaactattaattatattcctaaaatttaggccactttaatctcattgaatcttctagtctctatgaattcaatctcaccattgaagtttcttttagtttctagtattcatttagatattatgatataaaaatatactgaacagttactttataataaataattacttaaggcaaaaggcaaaagtaagaagaaactgtatactatcattaaaatatatttacatttttgcataaatgagaaagtagttctgcatttaaaagttgactggataatactaacactctcaaagggaggaatacaccttgaaattttttttttataattacaaagtggaactttaatagcaataacttatgctacaacttgtttaaaagaaaaataaacgtgtctattataaggaaaaaattaggtgagatgcaatacacaaacttatttcttcacctttgctaattgtgaccccactcttacaatatttacagtcatattttctatgggcctcactttccatttatatggggaaaaataaattacattgcaaatggcaagttctgctcttatttgcaaaatatataaagaaatgatgcttataaccagaccagagtgctgctcttcaataaaatatttttgtactagtgagcagcacttctatacagtgaaaaaatgaaaaaatgaaaagatcagagaaataaaaatatattttagaaagaggatgttatattcattttgctacaagctacaatgcaaaacgtatagtcttgtctttctaattcattgaataacaaagaaatcagcatgttgattataatgaataaaaaatgtttctttagactactctgatcagataccttaccagagacacatgctactttactatatttaataactgagtaactgtaaaaatacttttttaattgaaattagtcctccaagcatcacactatataaaatgtttcttttatgagaaatacttaaaactattgtgtcgccatgtcctcagttccacagtgtcagataaaaattttctcaatttaatattgtctgtctctggctaggcgcagtggctcacacccgtaatctcagcactttgggaggccgaggcgggcagatcacttgaggtcaggagttcaagatcagcctgagcaacatggtgaaaccccatctctactaagaatataaaaattagctggatgtgatggtgtgtgcatgtagtcccagctgcttgggaggttgaggtgaggggatcacttgagcccagctacctgggaggctgaggttgcagtgagccaagatcccaccacattttacacttaaaatatatttaaatttatattttaaatttatttgtaatataaatttaaaatctagttagtctatctcttctttcttggccagtaggctccacagagaacacttttgctgtcgatctcctaccacagggacttattctacctcaatgcctcactaaactcatttacattatttattcattatagagacacaaagcctggaaaacgcagacatacttttataaaacacaatcaacccacttttcccagcagtgtatttaggaggtgggtttgagtactgagcgctgttcaatgtacttaggaagtccagtcaaaaataagcgaggataggtccaattgctgggtccttggcaagattatgttatatggtcaaccgttactgacaaagagagtgtctgtcatggtcctggcggaaaacagaaaatccactaaaactgggtaatttatgaagagtttaatatagtaactatgtgaaagatttggacagagaatgaggaaaccacaggagaaggttgttccctgcagctagtatcagtgggccagttctgattgtcctgcagcagatgcgctaggtgccttgttttatgtcccctgaacctacctttgatttcagcttagggaagctcaacagttctgtgcacactgcaacccctcttcatttgtgttttggaatttttcagaacccacaggagatctatgagggtaaaaactgcatagaagagcaggggagttaatattctagaataaatggggtgggctgggaatttgtaagggcctatgctttccatccttcagagagaaaatccagaagaacattctacaaggttccttaaaaagttctcagcaggcttgagttgtaattgaccaaattttaaccacctcaatgaccttttttttttaaaaaaaaaaaaaaaaaaaaagactgtgggtacaaactaggtgtatatatttgtgggaaacatgagatattttgatacaggcatacaatgcgtaataatcacatcagggtaaatgtatttagcacctcaagcccttatcttttctttgtgttaaaaacaatccaattacactctcctagttactttataatgtacaataaattgctgttaactgtaatcactcttttgtgctatgaaataatagatcttatttattctatctaactatatttttgtacccattaaccatccactcttccctagaacccatcaccttccccagcccccggtaactggcattccactctttatctccatgagttcaattgttttaagttttagctcccacaaatgagtgagaacatgtaaagtatgtctttctgtgcctggcttatttcacttaacccagtaaccatcataaacatttttgcaaatgacaagatctcgttctttcttgtggttgagtagtacttcattgtgtatatgtaccaacttttctttatgcaatcatctgttgatggacacaggttgcttccaaatctgggctattgtgaacagtgttgcaataaacacagaagtgtggacatctcaatatactgatttcctttcttttgggtatatacctagcagtgggattgctggatcacatgaaccaaataatccagtaacataccttttattgattttctcttctgtcttgtcttgattctgggataatttctaataaactccttctaatcatatatttttctcaattcttcatgggagaaaaaaataagatacacccctgggccctaatgagtaagagtataaagcagttacactcacacacacacagagggagagagggagagaagtgagtgcaaaaagctatcagataaaagttctaacattagtcaaagaaggtatgtgtatgcatctatcacaaagagaaaaaagggaaatagagaccccaactttactttcttccttttctcaagactgctggccttccctattggccaaatcaaccaaatttcaaaagacagacaaatgtatttgtgtagttcctacaagtcagccacagaagaaaggggcaaatagaacacctccattcagcacaatgcagaaatctacattccaaacctaaattaattatgcctccttctactttctcccataactctatttcccctcttgctgttctaatatagtttaacttatatgataatactaatgggagtgtattatgtgtgtaaaatatagtttggaaaaataacacaatatcttcccatctatatatgttgagcaactttttcctgttttatgaatgcacttaagttcagtatctccagagattaaagatgagataattgctaattaaaataataactggaaacatttctaccataaaaatacattttgttgcctgacagtgtaatatgtgaatgcttaaatccaaatatgtaaatcacatgtattattgaataagcatgttcaaaagtagaatatcctctatatgcccaagagaaattttacaataatatgtctttggagctttaagtattcaataaattattatctagtggctacaacatgtaaactttgactttgagggaatataaatatataacatacagtaatctttaaggacaattataatgggatagtatacctccaaaggcctattagagctgaataaaaactcagtggtctatagactaattgttctgtgttcagtagtgagatgatgggaaaagtgttcccacaattatcaaattttaattttatatcagtggccagctgacactcttaactctgaattagctgacatttattgttagctctcatataatggacaaattaacatattaaaaaaccttcaaagtaagcaacaatttaacatttatatttgtactccaaaacagcagtaaagactagaaattgtgaatgttattttcaaataaacttgaggtaagaagaaatttgtcttgaagagtaaccaattttcatctacccattaacctattgatgtttagaggccagtaatattttaagattaattttgcattgcagtataatctggaaaaaattaatgcgaaaaagttgatctatgatgaacatttagggaaccacagttgtctttcagtacaaagagcggggattgattctaggaccatcacagataccaaaattcatagatgctcgagtcacggatataaaatgatgttgtatttgcacctaacctatgcatatcctcccttatacttgaaatcttctctaggttatttttaatacctaatacaatgaagacattttgtaattaattgtaatactgtattcttctttttattattttatattgttgtattgttattttttattgtttgttttcaagtattttcaatctgtggttggttgaatcagcagatgtggaacccagggatactgaggaataactgtactgcaatagtctatgaataaggaaataaatgtgtctgaatgaggataaggtagggataaagaaaagaagcactatttgaagaaactttttaaagaaatgaaacaattgttatctctaaaacttttaggtttggaagtcaagtgctttataaaaataatagttagaataatgtgataaatatcttttgtttttcaagagcagctagaacattttgttgacattgaggctagatgttgtggaattcccaaattatgttagcacactgataaaatatatacctcgtataggataaaatactgtggatttctctagtgtatcttagaatataatacatggcataatttaatatagttttcttttctcagcagaaaacatccattatcaagtatcataacaaaaaccacaatgctatcaattcacaagatcccataagtaattttattcttttaattgtattcaaaactatcttattttgcagctctttatcacctttaaagaaatgctctaaatctttttttattataatattacattatcaatcactgacacgaagtcatgagattttaaagttctagatgacctaatagtcaattcctttttattacagacgaatacatttatttccactgaacttacattacatcaagaagttaatataataaactctaattcccagtttaaacatttacccagaaattacatgtagatatttaatcctctcacttcaaacataatacaacatttgaactcatgtgtttttgtttgtttgtttgtttgtttttaacaagccacctttattttttaggagacaattctccatggttctcttgcattttacatgactttcaaatgagacaaggactacccctttttttttccttagatttttttcaagttcgttttcatagcaaacaactgaaaacaactcagggtctagacctgtaacaaactgcactgtgtgcaagtgccatctggccctcttcatgttaactggggctaggagaatcacacaaaaattctgatgctgtgactcctgctgtactaagaaataaactgccctttgtctctgacccaggaatcctgcatctgttgccagtattcatgaaactgtggccaactaatttgtcagtctgaaagtagagcaacctctcatacccttcggagttcttggcacttcttctcacttctgtaaattaatccagtcttaaaagcctaaaacaaaagtcatctgtaatagtatgttgaagtggaattatttctgtttcaatactcaacacaatgtcaatagaatagatattaagaataaaaaaaaccataagacacatataaattgcattactagaagggaagtaaaagaaactctactactcttgaacccccagccaaatcaaggtaacagaaagaagtcacaaaagagctatgtcatttttggaaattctcagcagagtaagtgatactgagtgtctttatttcctctcaaagaaaatcgtagtggattaatattttctccctctctctatatataatatatatgtataattatatatatatatataatttcttctccttccactcttcatataatattcaattaatcaatttgaataagcttggattcaggcacttttattgagcacttactgtgcaaatactccatgcaaataatttagggaaacaaagagaataaataatccctttctacaaatagctgatgaggggatttgggcatgtaatagtaattaattgaaacacagagtgtagtaaatgctgaaaagatggataaatataaagtaatgagaatgcaaaaaaaaaaagaagacttgatttcacctggaagatggatgcaaattttttaatgggctttgaaagcattggttagattttaaatgagtatgttgtaataggagagaaagacaagcaaaacaaagggaaaaacagatatatggttaagggatttatttgttaatctattactacatttttttcatttatccttagatcattttgtgaaagggaaatacatcttgggatctcaaactcattaagccagagggaaaagtcaagctgggaactgggtcacacaaatctgcattcgccttttcgttcctaaataagatggctacaagatgaaaggatatacacctccctcatgttttacagatgagaaaattctagtgggctccaagatcttaactgtaaaggttttctgttaaaatttaccatgacaatgtaaattgatgccttatcttcacaggtgcataggacagaactcaaagtcatctctctgcccacctcccacaaatgcatatctgactgtaccccttgccctattatctatcttatcttacgcaaaaatgcagattcacagagccaggcaaaggcataaatgactattgccccctacccacctcttacatgcaaaatgtttatttctcaatatcccaccatttcccttttacatttggagctctcaaaatcatcttcagagaaaggcatagacttgtctcccaggtgtgttcttaacttcggcaaataaacttcctgaaatgattgagatttgtctaggtcattgttcttgattgacaatttcaacattctttatatctaacctttgttcagttcaatctatcttgttactcttccaccacaaatatgttactaaaccatctctttctggtattatttttctccaaaagacttaacatggtgtttctctgatgggggacatttagaacctcacaaaatgacttccctctttagctttctcacattaactactgttattttccaccaaaaagttactgaatactatgtgtaagtttgaaacgtttattggaaataagaagggatggagaggagcaagtcactatggtaaattataggatgtgttcgggtgtctttctctccatcatccttcagaatttggtcttttttgaaggttttctcaatcctatttttccctgattacccctgaaagaagtgagtcttgacctttagaatatccccataatatgttaaaataaaactttaaaatctcaaattaaagtatagatattcttctttcaaaacaatagcataaatgtctggctgttgttgtagatgttgggttcatgggcaagttcaatttgtgaaaatccaataagtgatgtaaatctgtgtacttttctatatgtatcttgaacatcaattaagaacataccgtcacttgtgaagaaaggcacattaagaagtaataaatgggtctgcatatttgctaactgttcttttattatagtaaatttgtttcaatcatggctatttaacaacccggaagaacctgaggacatcatgttaaatgaaatatgccaagcacaaaaagacatatacctcataatctcagtcgcatggtggaatctaaaaaagttggtctcataaaagtagagagtagaatgatagctaccagaggctggggtggttagtggggcaggggaatgggaaggtgttggtcaatggatatataaagttagataggaggaataattttcaaaatatctattttacagcaaggtaactataattaataatgatatatcgtattattcaaaaatgtaggccgggctcggtggctcatgcctgtaatcccaacactttggaaggccaaggcagccggatcacttgagatcaggagttcaagaccagcctggccaacatggtaaaccctgtatctactaaaaacacaaaaattagctgggcatggtggcacactcctgaaatcccagttaatcgggaggcagaggtagaagaatcacttgaatccgggagccggaggttactgtgagccaagatcatgtcactgcattccagcctgggtgacagagcgagactctgtctccaaaaaaaaaaaaaaaaaggaaagagatattatgtattcttaccacaaaaatgcaaaccatgtgaggtactgcatttgttaattagctagatttaaccagtccaaaatatatgtttacttcaacacattatgtcctacataaaacacacaattttttctgtaaatttaaaaatacatattttaaatcattatctcagaaaaataactttgtaagatatttattttatttgataaactctaaaatatgaattttctttttctttttttttttttttttgagacagagtctggctcagtcacccaggctggagtgcagtggcgcgatctcggctcactgcaagctccgcctcccgcgttcatgccattctcctgcctcagcctcctgagtagctgggactacaggcgcccgccaccatgactggctaaatgaattttatttttcaaggctcagaaaaaacttactttatttttattgttttattgtatttatttatatacatatttttttgataaggagtcttgctctgtcgcccaggctggagtgcagtggctccatcgccgctcactgcaagctccgcctcccaaattcacgccattctcctgcctcagcctcccgagtagctgggactgcaggcgcccgccaccacgcccggtgaagtttttgcatttttactggagatggggtttcaccatgttagccgggatggtctcaatctcctgaccttgtgatctgcccggcctctgcctcccaaagtgctgggattacaggcatgagccaccgcgcccggtttattgcttacagtgacagttgatttccataatggttaaaataatggtaacttaagtgtgtacctcttgttttgtgaagaaaactaatattcaaataaaacaaacgcagtgtagataaaatcccaatggcaatttagaacgttgtcggtagaaaaacattttaatatttaattttaacacacaacatctttgaaaaactacaattttacatgtaaagtctagataaattttgtaattacaataaaataagcatgaatttttaaaagatgctgtgaaataaactagtatacaaattctagatcgactattaatcttcctcaccacacacacacagacacacacacaagtgtttgctaagatgaaaggcaatatttctgctatttatatctcattatttgaaatggcagacctatttgtttcctgccttcttaaaatctaatttacttactgctacaataaacacaggcttctctgattatttgcatccacacacagtgtctcaaatatcctatatttgtgtctgtgtataactgtgtacacatatacacacatattcatatatatattctttcatatatatatacacacacactcatatatatatgcctatatatatatattccttcctatatatatacatgtatatacacatacatgtatgtgagtgtgtgtctgtatacatctggacctgtgggtctggagtttacatctgaatcagagaaagagattttatatatatgatatatatctgtctctcatatatataatctttttatatatgtatatataaaatctctttctctgatacagatgtatatctgtgtacacacactcatatatatatatatataggaaggaatatacatatatatataggaaggaatatatatatatatataggaaggaatatatatagagagaggaaggaatatatatagagagaggaaggaatatatatatatataataggaaggaatatatatttctttctctgattcagatatgtatctgtgtacacacacactcatagatataggaaggagtatatatatatgaatatatatatgggatggaatatatatatatattcccatatataggaagaaatatatatgtatatttatatgagtgtgtgtgtgtacacagatatacatctgaatcagatttcatatatatatagaaagagataaagggataatatattatatatatatacacacacatatatatatacacacacacatatataatctttttctgattcagatgtaaattccatacccacaggtccagatgtgtaatcagtgatatcatatacatatctcattagcacatgaaatctaacaggtttagaactgaactcatcttcctcttgctttcttcctctatgtaccccatctcaagaaactgcattattatttatttggtcaactgacttagaaatctaagaattatccttacttccttatattcttgaaagctcatgcctaattggcatgcattcccatcagctctacctttatacactcatgagtgtgatcccctcctgccattcccactgccactgggtttgctttatttcaggccttcattatttctattctagattgcagtgacaacctcttaacttggctgcctgccagtagtcactgctgttcctctttaactcgttctccaggctgtggcaaaaccatggttttttttaatcaaaacaggatttttaaacatctccttgacagcagaatctgattatatgactcttctacttaaggtttccagtgcccatgggataaaatctaaatcctttaggaggcatacaacctctctccctgtatctctaataccttttaatgtctcttttcatacattatgttgtagccataccccaattctagtagttctgtgtacgtatgcatgtgtgtgtgactgtatatgtgtgttgagtgaaaataacagcaacaaagaaagagagattgaaagatgaagagacagagaaagagaagaaatgaagagacagagaaaccaaaatttcattgtactttttgatctggctcatgagatttcagatggttttatgttcttctttgtgttccctcctattttccataatttctcaattgtcatgtgtgttttgcaattagagaaataatctagccttacatgacacaactgaatatttgaaaactgcatagtttttgtttcattttaaagtccacctcatctatttacagccattctttaaaaccatatgacaaattgactttaatcattttgaaaattattatagtcagttacttttagaactcctacattcttataattcttctgtgaataaatatttacttcaagacaaaatatgtaaattaattatagcttagtatgacctttatacatattggaggagttataaaatatatattttatcaaagactatactcttagaatgcaataacagattttataacttatttatacttgtatagaagagttacataaatataatatagtttattcaataccatgtgattagaaattgaagtttcatgatggttttgatatttagtatatattaaatgctttctacaacataaaacagaaaggttcctgcgattgaggtacagatcaagtgtaaggggactttagagtcagtaaagattataagattacatttgatttttactttatttatttataagtcatttcacaatactttgttagactggcagaatattaagatgaaaaaaatacctggagtaaaatttagtttgaatgaagttttgacaaaaaatattaaaagtgagagataagcttgtaattggttaaaatcaaattgtaaaagtctcaatttcaggctaacaaggtttcacattattctaccacacaatgtaagtcatttcaatattttccacaaatggaagacaggattcacatttctgaacaggaagatgagctctcataattatatacaaaatagattgcagatttatggaggcaactgttaacatagataataattattctatgataatgacattaggtaccaatatttatcaaatgtttaactatagtctatgcagtgtgccagaagagatacatactgcctgaaatgcacacatatttaacattatgtatataatattatgtcatatattatataacaacacattctgaatactaaaattcactaagaattagtgttttcctactggttttcagatagggacattgacttagctggcttaactacatattcacaaagccaatactttgtaacttatttggaattcaactacaaagagaggaatatagaaatacagtgcaaggcaggagggaggtaaattaatgttatgagcaatatggacctgggccaggaaaatagccttatactaagtggaaaagcatagatgatagaagttacatcacttaggtagtcatggctttaaagagagaatgagggggagaaattgaaaatgcctgaaagcttgaaggagaagtcaatatctggaggatatttttgtgggaagacagatggcatagtcagttttcattttcaggtatcaaaataatagccagttagaagaagtttaaaacataaaagttggacttaagggaatgaagaatataggagacaggaaagaaatgacatcttactactgcacattttgttttggaaagtgtgtatattgggatgataattaaagccattatagtccaagaaaagggcatataaaaaacaggcacgggccaaagataaattattgaggaacatctgcatttggagcataagagaaagatgggataggagtatgtgaaagttgagtcacaatgtaatggatgaaaggttagctggtagtagtaaaacagagataacaagcaaatttttaaaatagtttttaaatcatgaaaaataagataatgcaataacttcagagggaaaaactacgagggagttttgtgtttttcttttttgggaaaggacaggagggtgacatgctttacagttagagaaagaactagttggcaatcaaaatattaaaaatgcaaagagaaaaacagaaaattgctagagtgggatctcagaagggagtaaatgagatcaagagcaaagtcacactgtctagatttaaagatatctactttctcttctgagacaaaaaagagtaaactaaaaatatatcagaggtgaatgagggggtggggagttcctgttgaatgatttccccaaccttgacagctagaaatttctgtcctatgaaaagtaggtgaagttggattgttattgagggcttctatttggggtgaaaaggtttgttaagagtatatatgagaaatgtgaggaggaacaatcaaagttgaaataaagaatgttacataatagaacctcacaacttctcttcccctgtcataggtattcagtatgcatagatcatagttcataatatagcgataggactctaatttaggagagtagttttaaaataccactctggtgtttatttgctgtgtttataattcttgttcaattagattaaatttgtcatttaccatagcacgtgtatcatccaagtagctgaggtagtataatttttttgtcaattatattttaatatttttcaatatactgattcattcagcaaataattattaagtgaatttcttcctattcaatcttgtgttaagtattggggaggaaaaatagaatgttactttgatatttcagcatcataataagtattaatcttacatgcaaccacaaaaaactcaatctgtgccagattttactttaaaacctcaagcaaaggtcaatatcagcaaaagtaattgaactcatgtattgaccacttactttgggatacattttctgctaaatatttccatatattctctccttaaccctcaggttaactgtatgatgtagtactattatttttctcattttatagaaaaggaaaccaacaaaagaggttaagtaaattgctaatgataatatggctaaaaatagtggaactaacttgaaccaaatctttgtgattcccaaactggtttattttactagggcaatactaaagaaaataaaaagtaagtaaatctaagaagaaaatttcaaaggatgaatgactctcaataagaataccgtctgagctcaacgacacgtctaaaactaaaatcaaacagacaaaatgacctcacgtgcacaaacacatactacctgaaaaagaaagcatttatctttataacaaagacaaattttgagaatttggaaattcaataacatatcgtgactttataaaacagctacatttaactttaaatattaaaagcaaaaatatggaacacaaggctagccaatatccagacttcgcattttttttcttgaaatgtgatcattacctcttcatcttccagtgatgctcatctgagcataaaaggaattgacaattcatgaagatgcaaccatattcatgtctaagtttctctggcaaattatacagattctctgaaaattatacaaattttcagcctgtttttgtctggtgttgtaagctacacgaaacttttaaagatcgtacatgtttatctgcttctagtgatagataactacatatcaccaacaactttcatatatcatatttgacaacattgttaaatattaatccatattctgatttaaagtgctttttctgtttcacgtaatcatagtgaaaacatttacttaaccattttaaaattgcattcaaattttttttgagtctttccataaacttgggaaacaattaaaatattattaatactgcattgtaccaataaggagagtgagacttgagtgattgagtaacttgctgtaagttgccctgtacgtttgaaaattgagggctgtaattaagaataaatgtttctgtatcatcattcttactcttcagcattgttctttaaataaaattcccggccatattttctgtccttgtacctagaacaaatatctacaggataagaatgttaggttgttccctttacatatcccaaatacccaaaatagtatctgttatgttttatataaatatgtgtgtataatatacatatatatatgaatatgcatgtatatatataaatacaattgtcctatccactagtaattttgcttcagcagatgtagtgtggtgctgacaatcaggtttaaataaatgatgtagttttctaaaagcagaaatttgattagctcttctatatgtacactagactcaacacttctgtgctgagctgaagtgtaatgaatgcagataaaacaaaataagaaaaataggagagacaggaaaactttggtaaagaatattaggggagaaaatcaaactaaacaaaaaaatcgaaacaaaataaccctaatggcctagaaagcaccctaatgtggtcttggtcaatcaatggtaactgcctgttccttctattcctgttgcccattcttgtgtatttgaattcgtagaagtgctgcaccaacttttctctctgtttaattcttgacacttctatgtagacaatgatgggtaagggaatgtggttgaggagaaaggagaaactacctaaagagcaacaaaagttgaagcagccagttgccccaaggtccaaaagaacttgactctgagaaagaaaagacagccaatagtgatgaaagaaactgaactttcctaatcctaaaacaagagagtgatgacgtggtcccaccaagatttcaaagaggtgaataaaagctcacaccctaactgtaatattattatcatttcttcaattattctttaagaaattgatggaatatgagtttaaaatattttgtcttacacaagttaggctgatgagctggttaagattttataatgttttggacacatagaaattaagtcagtttccaaaaatatgaatactcatatgtaggcaggtggtgtaaattagaagttgggtgccaacatgtgcctctctttagtttgcaatgctgtatttactgcaaaggagaaccacagagcagccattatcatcatgtgtgggatcttaacacatgccagagggctgaggaatcatacagagagcacgagtctcagtttcctcaaatcatctgtctgtttgatttttcttgagaagtttctacagtggtgaagttgagggatattttgtagaataaacacagctaatatttctaagattaaaatgagctgcaaaagattcctggataatacaaggcttagcaaattgagtcatgacttaagagaaacaatctggacgctgagctcagaaaagaactaggaaagacagaaaaacaattaaatacaacaaaatctttttggaaaagttagatcaagtaagagagaaacatatcacagttcttaaatttatattttaaactaaaccatcaaattagaaacttagtaagttctgttttgtttatttaaactaataaatattacttacaatgaatcacaaattgtcataggcagcaataaagaaacattctgtgaattttcacgaatagaaaaattgcattagaaataatgggagcaaatcaaatgaatggatcagaataatgatgtttgcagaagttaggggaagataaaataattatacatatatgtatagaaaataaatggtaaaagaagcaagctgtaaatttaaacttccaaaataatgctaatgcaaaaatacattaattaaatacaatttaggataagagaattagaaaaaaactataaataatgctattccttgaaaagaaatgcagatttttttttcaatcacataaaatgctcaaagtaggcacacaagaccttgcctagtgaaagtcctttatcccaaacaaattgatgacactgtaagatttgtttatacctgccttgtatagtttagttgttaaaggcagaaagacctgaatttgaaatccatctctacctgtattttaagctagtgctttatttacatgctgattcttaatgagcaaatacatcataatctgtgttgttaggaaacagtgtttaaagatttaataaaaaatgcactggtatacagtttataactccatgtgtaaaccgaagacctcagtacattgtattcatagtttctgtactagccagattactcccagctaaaagtaagacaatcagtaataaaattagctaaaaatagagaaatttatcatctcatataaaaggaagcagggtaggcttcaggattatttgttttaaattggttatttcaagacctcatcaaaagtcaaagcctttcaactttgtgggcatgagtctcagaccggcattaaaaagacaactgtagggcttggtgtcagattcaggaaaggaggggctgtggtttgaatatgtcccttctagaattcagatgttgccaatgtgatagtatttagaaggtgaggttttttagaggtgattgggccataaggcccaattgtgactgtgcccttataaaaaggtttgactaaggcagtttgtcttttttgccattctaccttccaccatgtgaggatacagtgttcctcccctctggaggacgcaggactcaccagacaaccaaacctgccagtgccttgatcttggactttccaacccccagagctatgagaaaaacacatttttgttctttataaattacccagtctgtacacacacacacaaatgaactaagacagaaattgatacagggattggactattgttgtaacaaatatctaaaaatgtggaagcaagctttggaacagggtaatgtatagagactggaagagttttgaagggattgctagaaaaagcctctattgatataaactgaaaattacgggggatctaccaagggctcagaagaggagaactgcaggggaagcctcagttgtcttagtgattacctaagtggtcatgactagaatactggttgaaatatgaacaataaaggccattctgattaggtcccagatggaaatgaggaatatcttattggaatttgtagaaaaggctatcctggtttacaaagtggcaaaggctaggctgtctgtgtcctaggactttgtgaaaggcagcacttaagaatgactaatcaggatatctgacaaaaaaatatctcttagtagaaaattgctgagggagataccagggatttgttaactgattatggtaaaatgtgagaagagctaaaaaattaaaagacagaatttaacccacttacacctagtgttccattattggaatgctaagcttgtgggagttatttataccctgcttctcaaggtcatcaccaaggcctgatttttgacaaaaatatttgccacatctggcataaatgagttaaaatcaaaaggaaagcaaaatgtaaaaatctgtaaaattcccaggctggccacataaacaatgaaaataaaaatctgtctagcagagaaaaccaagggatgggtcatctactattagataaggagactagtttggatagacgggtgccaggtgctattcatcaagacagtgggagagtgactctgaagacatttcagggtttttaaatgctgtcatgcccaccacaggtccaaagtgccagggccttggtggcagaacagtttcaagtgaggaagagctcaggttacctgtggaatttcagtactccaaatgttcttgaagcccagaactccttcaagtctctgcacccattgtttttgtacagtgctaattggctgcttcagttgtggtgtaggtggcccagttgtgcctgaaatcaatgttccagagggtgcaagcattgagccctaaccatgccaccatgatgctaaatcttcagtcaagcagagtgcatgagctgtggaggcttggatttcaaatcatctctacctggacttcaagtgatacctcagagagcctcaggttctaggcagagaattttgtcacgggcgggagcaccaaagagagtcctcaaagggagaggcatagtgcaggagggggcagggggacagctacatcacagatagcacccactagggcaatgattgatggagttgtggcagcagggccgctcgagaggccaaagcctgggagagccacaggcactgaactccaacccatgagagctgaagggagctgtacccagcaaagccatgctaatagggtcctctggggcatttggggcccaaccttaccccagtgtgtccaggaagtgggccatggagtcaaagattgttcacatgtggtttgcctcactgtgttttggactcacttgggacctattacccctttcttcttgcctacttctcccctttggaatataaacgactgtcttgtgtctgtcttaccattacattttgaaaacatgtaacttgtttgctttcacaggttcagagctggagaacaatttaccccaggatgaaacactcttgagtttcacttatatgatgtttagatgagactttggacttagactttaaagttgattctgaaacaagtaaagagtttttggagctattaagatggaataaatgaattttttttaatgtgagaaaatcatgaatgtgagggagctagggatataatgctatggtttgaatgtgtcctctccgaaattcaggcgttgccaatgtgatagtattaaggggtaaggcctttaaaaagggattaggccataagggctcttcccttctgaatgggattagatgtctttattaaagggcttgatggagggagtttgccccttttgtcccttcaccttctatcatgtgagggtacagcattcctcctcctagtggatgtggccttaccagacaaacaaacctgtcagttccttgatcttggacttcccaacctttagaactctgagaaaaaaaaaaaaaatctttgttttgcttttataaattacccagtgtggtatttcattattgcagcccaaaaggactcagaaaaatagagttcagagtgataaatacactgtattttcttaaactattttttctttaggaagcaagagattacctactgacccaacaagtgaagggttataatgcataaaaataatactttttcctgtgtgatttatttttcctgaatgacaaagcattcctaacagtgagagttgaatgttatttcaggaaatagggaaggaggtaatgtgccccgtcactgacaatgttaaaatgatcaattgcagatattctagagcagactcaagaacttgagacaaatatataaatcttagattactttggcatatttttttgttttctttgtaagttaccatttattaagcatgcatttattgactgcctactatacgccaaccagtagaaggacacaattatttcactttaggcacaaactcaaagtaggcactggagatacaaaacatgaatagatcaattcctgttggcactatttagaaattaaagagaatctagactctaaaaactaataagaataaataaaatatgtcatttacatttaatttctagaatgaaacacagtaaacagacattctaaaaaatacaattatgttttataaaaacctgtgatatgtcatcattttgataaacaccctttttggtgaaatcttatattgcaattattgtatttatatttattaatgcattttatacatgttagttaaatttactacttcatataaatatctaacatttagattccaaattaagctcaaaataatggaaaagatattgtaatgaggaataggaaagaagaggctgataataatagccagtttctctggaggcatgatctgggaggatacagctgctttcctttaagcagtggccagtgtcttcagaaaagaaatgtttttatgtatctttacatgaaatagatagatactatttcaaattacaaattaactccaacatagggaatcttaatataatgatcaaggtatgtaatctaaatcttttaaaaagaactctgatcttcatttaaacttaatttcaaaatgaagagtaaacattagcatgttgagtggataattaaaaaataaattatattcttatagcattatttttgtatgcaattagcattgcattctctgcttgaaggataattcatacaacccattaccctgtcccaaataaaaacttcctgggcatagcctatcttgtctttccttacactgattcattttctggaagaccattttgttcctttttccctttttcttacttgtgaatttttactaacttaaggcccagttcatattatcctctctgtaaagacttcccttgagacccaaataaatttgttgttccctccaatatgttcataatcctactataccatgcatcacagcgtaataaagttaactattcatggtactctgggactttcttggggcaaaagcaagagcaacattgcatttaattttgcatttttaaaaatattatagatacttagaaaaggaggatgctcaataaatgcttattcagtaaatgaggtatggataattatgcaaacagccaaagacattacttaaattttggctgaacggaaggacatcacaaagtttttcataaattatatgaatatgtgtgataatgtaaacaaaatagaagagaaaaatgctccactgatggccatagggggtagccagagtgtgaatgtccaattttttttataatactttggtcatgacctatgattgaatagatatattaagaacgagaaggaataaaattattcatcacatttattctcttaacaattagttaattgtacaccttgctacggtttgaatgtgtccccccaaaggcatgtgttagaaacttaatcccccaaggaacagtattgagaggtagagactaatgggaggtctttaggtcagagggctccactctcatcagtggattaatggattaatgcccattatgaaaggacttgagacaatgagttcagtctcttgctgtatatcaccatttcttttcctttccgccatgagatgatgaagcaagaaggcttttgctagatgctgacctcttattcttggacttcccagcctccaaaaacatgaatcaataaatttctgttaattacaaattacctagactgtagtgttcggttatagcagcacaaaacacactgaaataactattacacttattatgcacaaatcgcactaaagccatactggtttattttagaatgtacaatttccccagataagacaagctccggtatgttaagagtcttagcttagacagattctggttccctactctgtagtatagaaatttgatccacttccaggtaccagaaaatatgagctctgagtttatggtcccgctcacatttcagctcgcaccagcctgtggaagatttgtggcagtatatccctcctcagccactccttctcaagttctgtactctgaaagcaactgcaatttccttgacttttgctgcattcagcaaagtcaaagaatatttgacaaagaatatttgtcctcagaagatctgttaaccaatgtgtaactctagctttctatgtgtttctcaaaaacatatcgtatatttatctaaactataaacaataaacttaaaaaacaagcatattgttaatgaatttagatgaaatatccatctattattttagatggattgtataaaattcaccttgtatgagagaaattaaaaggcactttatctgtgttagcatacctaggaactagttacagcaagctggttttgttttgctttcaaaaaattaaatattcacctaacataattttttgtctttcagatcagacttctgattataaaaacatggaaaattgaaaattaacctgtcacccctgaagataaatagttagacatttttcccatcacagaatcagaagacataatgttattttccaaagagttggaaggtaaaattcaagctaatcaaaactaattatcccctcccaatagaaagaagaaaaatatcataaaggatctgatcttttcagttttaaatatgtgggtcaattgttaatgacatcttaattttttttttttattttgagacggagtctcgctctgttgcccaggctggagtgcagtggcgtgatctcggctcactgcaacctctgcctcccaggttcaagtgattctcctgcctcagcctcccaagtagctgggattacaggcgccggctaccatgcctgggtaatttttgtagttttaggagagacagggtttcaccatgttggccaggctggtctcgaactgctgacctcgtgatgcgcccatctcggactcccaaagtgttgagattacaggcgtgagccaccgcacccggccaatgacatcttaatttttaagaaatcataaatgtatatgaaaaccatagtaaaatgtctttacatatagctatttgacatcatggatctgaaattaaggacaactagctgaagtattagcttagaaagaaagttctgtttctgaagattgtaaaatatctgcggactcatggcaatgttaccttttatttgtgactcttaagaagtatactgtttgtcctaatgatttgtcttacagttacactattttcgttcaatatctaatagttttagcattaaggtaattatctgtcatcttaaatgtaatatctttattcttatcatagtgttatcttggaatgaaatatattatcatgttgatattctgtgatacctagcgcatatgactttcagaagtttgtacccatattatttattctgcttaaattaatttaataagcaaagcccacaagtaaattttaaattaagtataatgtggctacacaacaacacagaaatgatctagataaaatatattaatcactcctctggatttcaaattacttatgatttattctgaatttattatatggctgtcaatggccactgagctacctgtttatacacacacaacacatatatgtaccatatttatctatatacatattcaaaagagcaaaaaaataactaaacatttatgcttatgtgtttgcatgtgagtatagtcttctttggaatttgattaataatttcaaaataagaaaacttttattttctccaagagtaagtttttctataaattgtaaaataattcataatagatatttaaagtacacaatcttgcaaatagaagtaaaatcttagttcctattttgatttaaaatgcaatattttaaacctatatggatcagagaatactttgtactggtcaaggataatcaaaaattgctaacttgttttcttatgctaaccaatggttgtgggccacacttaaagtgaggcaaaactggaaaacattcaaaaagcagaatttaactcttttatacgagtctggttatatcaggatttaccttaattaaagcttctgagaaagtgggcaaacccttaataaccatttgagttatcaagatcttctgttctgatgggcagttgtgggacggggactctatagtagtaatgatcaccactgttgagtggcatgtccatccaatttgggtggtgaaacctgaaacttttcaaagtagcagtgttggaagggattcactatgatcatcatatttcaaggctggaagcaggaattactgaaatcttacctgttggaaaccatattgacctaaacaagagaattccacagtgtaaaaattctctgaccttaaatcaggaatgggaataaaagagtaaaaaaagaatagtttattccgctttgtccaccttaaccactatatagtcgtctttattgttattatttctattttcttcatttcttacaggtgcggttctaaattgtaaatgtggttatcttttaaaaattttctcattaattatcccatatctcaacatctcttctttaccatccacaccagcatattccctctctccataccttcccaggttccgatccaaacctcattacagaaaactaaattagaaattagattggaaaaaacatgtaaatctctcccagaatacagaaaaaaaagagagaaaggtaaaaaattaagatgtgagatactgaaggcagaatcagaaagagcttattttaattgtgttcatgaagaagagactaaaacaaaaaaagacatgagcagatatcagcaatgaagagtttaaagaaatgagaaaaaaatgaatcttaaaatgaatcaataagggctactgattttcaggaaaatttgaagaatgatgcaaattctaagaatattcctcttccagtagttaggcatataaaaaggagagtggtgagaattctaagaatcttccttttccagtagttatgcatataaaaaggaacagagatgctgataattttaacataattcctaatgctttgcctgcttctcagaagctatgattaagacaaattctgagaaactcatgaatactcccaaattgaaagagaaattttaataaagacacaccaagcagattttctttttcttattgagaaaacttgagggagatggaggagaatgtaaaagtggcaagtgtggagaaactagtgaaaaagagaaatcatacaatccaaagcaagttttgatgagtgatatgttacagcgtttataaatgatttagtaaattacgccaattccttagttagaatgaagtgactttgaactaaatgaccagacaaaaagcacaggactctgttcataacccaataagtgtcaagtctacacaaaagtgacaaaacaaacaaacaaaaaaacccaccatcaaaccataggtatcccatatggtggaaaaggagtaatggaacattcatccatagcattttagaacaaatggctgtaaacagaattacccaaatttaacataaccaagaaaaaatatattaaattataaaaatatattaaatactcctaataagatctcatggcaataataatagaaataatgttctgagacccttactgtctaatttacagaactagaactgtaaaatcatgtgctcttgtggttgtgctcttaaaagccaataagtaggcgataatttgtcaatggcagcaataggaatttcacatgtaactgaaggacattttacacactcaagctgtgtccagaaagaaaacagacaggctgacacaggcttgaaagaatggtgggcactctcctggttgttctaatggggttgactatgaactacaggcccagactgttcttccttgttttacatttacatgtctaaggggcagtgagatttcccaatgcagtgagtgacttgagaggcagctagataacatgaatcaaaaaaaaaccaaaacaactacaacaacaacaacaacaacaacaacaacaaaaacacaggaggcaagaaagaatgttaaaaggaattagcattctatattttcttgtcctctttttccatagggaagactgaccatactgtacatattcgaaaactgtgatttaaacatatgcatggacactcacatgcacacatacacacaatctttaaaaacaatgttattattttaagaactcatttagaaaataatatcttgaggtaaagaaaatgtttctaaatatcaatatataatagttttatttttcatgttctataacactaaagtaaattaatttctctatctagttctattttatgacttttttctcatttccctttctactttatttgtatctgcagagagagatgagataaacattgtgaagtaataaccatgttctttatataaataatttgaaataagaaattcaaactaacacataaagaacaaatggcagtagattccttgattatatttattagcaatccaattattacaagataaatattttctcatactattaaacctacatttaaatattatttatcttgtatatgaaaaatgtgtaatatatttaagaatattttactttactgtttaaccctaaccccatgtctatcatcctatagcagccaatatgactaaaggcatttctattttacatatcagctatttaaagtaaaacatgtattctcaccatcttaaccaaaacagaaaggcaaaaatgcaagtagtcactttcaatatataatgaaaatctagctaaattacttatcaagagcagtgagaaaagttgtagtgacaaaaacaatgcatctacatcctttaaggaaatttccatctagttttggagctagaactaatgtatgaatcatatagggaatcatcattaatctgaagggttcttactccaaatacaactgaaattgcattggttaagtgtttaataccctacttccaaaatcaacaggaaaaatagaaatctcctgatattttctgaaagcaatcacattgcaatcttgtgaaatgtcctgcatttttttttcttggagtgttcctgaattataaatgtttaagaatggcagcaggcaaatctattctaaataggacagcaagggggaatattggttactgttcatttgatcctggtgtcttggttaaataaaactattttgtctaataacttgccatcttcttattcaagaatataaatacattgggattaattttgtggtgccccaatataattttgcttgaattgggatttagaaataaacttttttagaaaaccagattttatcatttttctttttttaacttataaacaagttctgcatagaaactgagcagatagtgagcactcattgcttgggccctaaatagaatacaaatacataaatcatcattcttatatgagactgtctcatttaactgaacattttttactagcatacccaaaataatattacacagtgtattactattcatgatttcatttggtcttcactctaccataaggcttattcagatacaaggcgggaagagttagcacagccagtgtggtgagcaagcctttcttgagtatttaagattttagctaggtcttaacaaatggtaagattcttagacatgaagatgagactctaggaaattcagagtgaaggaaaccatgtttataaccctctgaaggaagaataggcatgctgaccttgtagggtggtgacaacaggagctcaacaaattatattgcaaatataaggagtagactacttggagagggccttgaaaacagaattctgacatcatgaaatagaaactattacataaaatattttggcaggatatgacaactaaaaatggtgcttaagaaaaattgataatgaagtggtattggagaggagatgaagtatacagcatatagtgagatcattgcagtaacacgatattatgtaaaagaaagatttagtgatacatattttgctgcaataaatgtattcataaatttggagtaaaagcaagagacattatttatgtattgaggcatgtttttagtcttgtcaaattattccactctgtcataaaataattcaaaatacattagtgttaatggttgttgttttgacccaaacaagtcaaagggatatatatattttttaaattaaaagtcactcaaagtcatgtctatcagtgaatttatgcacaggcactaactggataagaaaatgtagtgctggatcaaagcagtgacagagaagaggccgcctattttttgacataattgtacaaacccatgctatgatctaccttccagtctttcaatataaatttatttaatacattttgatcttttaagactcctggaagccatatttaatttacatgaaaattaaatgtgtggttggtctatatgtgtaagctaaaaataattttacttgtgtgtgtgtgtatgtgttgcatgtcagcccttgacattctgtttgtcttgtctatattctggtttgagaactcattcattttcatgactttgttcattacctctttgctggtaatctaaaataccatatgtgttgctcctaaggaatgtttttagaacctttgttttctttttgtttgtttgtttttagaacttatttttttggtgagagggaagtagattttttttctacgtggaatattgcatggaagccaataaatttccataaccctcctctcaattcctactgtttctttactataaccttattttcaaatttccacaagatttttgtcttggaatcatctgtcctttttttataggtgagatgcaggattatatctggatgcactcacctgactaatttctctgttctctcattgattctcttaagagtatcctctgtctacataaaaaaacaggaaaaacaaaataaaacaaaaggctgggcacagtgacacctgtaatctcagaactttggaggacccaggcaggaggattacttgagcccagaagtgggagaccagcctgggcaacacagtgagatcccgtctctataaaaaataaaaaaaaataacttgtcacagtggtgcatgtctgtagtcccagctactcgggagactgaggcgggaggttcacttgagcctgggagctcaatgctacagttagccatgattgtgccagtgcactcaagcctaggtgacaaagtgagatcctgtctaaatagaaaataaataaataaataaataaataaaataaataaataaataaaagattaaaagaagaaaaaaacactcatagaaacctcttacgtgagtgcaggtaaagactatctggatacttgcttacatagccagttgctctggcaatgtgaaggggagcagaaaagaagagggatatgagagggtatttgaatgggttaaaaactacagacaagatacatcaaagattgaacggtaaaaagcatttgatataaagaccagaaataataaaagagatccagaatatagatcctccaataacaaattgcttgtggacagccactatccatcagctaagatatttaaaagtccctctgatcagacatcttggaacttcaacacctgtatagtgatggagatatgaaaggacatttttgatgtctcaacaaggtgataatgtcccgatgcaggtgacaatctcctcataaacaagaacaactatggtaatactaccaccgttgcagagttactagaaatactgcaccatagtctttcagatgtctttagttttcacctaaccagtttttaagtttacaaatctattctgtgtatgcagttatgtcacaaaagtaaacataactttcaatttgtttctcttctttgaacaattggcaataacctcctagtattagaaaacctaacgcatatgataactttcaaggttttcaacactgtgactccacttattttcagtatttcacaaaatcagttagttcattttagcctagcaatttccctaaaaaacctactacctccatattaatttaacatattatgtcaattcataggaaatcagaggtattgacatacctctacattctctagactcaaagccaatgtaaaaggttcggttcccatgagatctgcagtcaaataaactataattaccttatacaatttagaacttaattatgtactatatgtttattgctcactgtttttatatacataagtctacactagatccttccaattcccattaaaaaattcctagtataagttctccaacattttattttatcactaaacaaatgcttattgaaggcttgccatgtgttaggtgttattcaatgtgctagaaacatagggaatgagcaaatcacaatccccaccctcaatggactcatcctccagtgataacattagatacccattccttccccaaccttatcagtgtctagctgttgaatattgctgaagaagttcacaaaatattatatgtttcatcactgggcttacctgacccgtatctaagcctgcaaaccatactcattctgtaaacacatctcaagtgatacatttttacaaaatctcttctggcatttctctattagatgcaataccatgctgctctaaaaacaccaaatattgtcttactaaactctctgataaaattattacttgtatatttaattttatcccttctccattttgactgtatttcaaagtgttcatgtcatactgatctttacatttcctttgtacccaagcctcatgtcttatagaacgtagatgactcaatatacgttttaccattgattttgttctttattcattttatccaataaacagtttcttaggtctgtgtcagatgttgtggaaaaatttacacttccttgatgtcagtgttaaaataatctataattgaaaatcaaataacttattcacatcctaagtactataataaagcgtgaaaaatatagggaggagaagtctttattcagaagtcaatctgtttcacaagatctttgtgggtacacaatcatgacatacctttttatttacttcaaatgtttcatatgttattcttgttcacatgttcaaattgttttttgaatttactaaagataactgttttgccatttgggttaaagttggccaatatagtttgaccaatactatctacttctttaattctttaagagaacaaaattctgccaatgtggcacatacaaatgaaagataaaattaatgcatgttcttataaagaacagctcatgatagagcattttcacaaaaaagtaatgccagtaatgtcaattggtgatggagaaaaattcagagatactggagataattttccgctatcatcctgaagcaccatgactctcaccacaaaattaatgtcctttttccccgacttttcacttggaaaaaaaaggtagaaatatacagtatagctgtaaaataattgttctccagtaggactcatcaaaacatgtgtgaaactttcccagacatgcaagttttattgcattaaatggtatatattaactttagtgaaattcttgttgacaaattctgccagcctctgtttactccctctctatgtactatgtactaagcatacagagggatttgctcattgtagctgcctcaaattaagcaaaacagatttttactgtgctcaattacaaatcgtcgttttcacttctgccttaagaaggcttgcaaaatacagtctggccttcttggaaggaaatacctgcttgtgaggaaaattgtatctagcagcccaaaagaggagcttcgaagctcctcaggcatatgaaaaacgaaagaaatctcacagatatttcacaaatcccatgtggtgatatctgaatggtgtgtactattgttttaaatatagattaaaaaggtaataaaaatctcttttaactggcctgtaaggctttgggtaatgaaaatttcaacttcattatacattttgtagaaactgacattgggcctgatctaaaggagggactcaaccctaattttggcaagcacataattaaaaataaggttatgaaaaggcagagaataatttacattaaatgatacagatctgagaaaatttccagactgctgactgcattggagttgcaagctcagcaacatttcataataagtagctcccacagcacataaactgaatcacttgacaaaaggcagatgaggaatttgaaaccactttggatttgacatttttgttgaaatttaattgaaaaagttatagaagtgaagataatgtgaggaagcagtgcataaattatggcatctctttcacacagttttatcacatggcctcatcaccttcctaaaaaatcatatcactgatttcccagactcttatatgactagagtaatatagatcacatctcaatacattattaatttaaagtaatgagtttgaaagcaaaaagaaatgactcttttaaaattacatattcatctatattcaatgttgttcttgttagtaaaaacatgacagcttgcagcatttttttaatctcgattacattctagacagtctcatgcttcagttgaatatctaagattaattgaaattgtttagaaaattacatgaaggaacaaaatgttatctgataaatattcatcaaaagtgtcaagttctattgtatttaaacttgaataagctagtccattattagtatggttgaaatacttaatactatttaattcttggtacatagcaaagattcactcatatatagtaagagaaacagacataaatacaaaaacaattggttgctaatggtaattaaaattctctttttaaagtattataagtagaacaaaacatatccattacattgattattactaataaaattatgtaaaaactttgtaactgttgcttaaatgtaaagacttcaatctcattctgaattaaccagatcagattgcatcttaaacttatatattatcctctgcatttgagatattttcttataaaagtaacttctacttttgaagaactcatagctaactggaaagaggaaaaataagcaacaaataaagtgtagtcaggaaaaagtaggaataaagagggggaagtgacaagcactaaggtttggagagatgcaagggtactttaagaggtttgagtaggaaagtatttatggagaatggagaatgagttggggaagttgattgtaggtcacatttttagcatacaattcccctactttccaaaaaaataaatgttttccttctcattttttaatggaatgtcttctgaacctactttttttcagttttagaatctgaagttccatattgaggcttcatcataatttcagttatcagagaaatctagcaggaaatttattttctttgaatattggaaataaaaatgtggacacattttaatcagtaagtaagtgtgttgattgtgttactaagttgaaaagtggcaatcaatagccaaaccttcatcttacaagcaatggcttatcagtactatgcagggttactatttaaataagcgtattttacacattagccgaagaaagataccataaagcaacaggtgctcatcaatactggcactttgaatgctctgatacttcttatatgtttaagaaaaaaggaggagaatcatgaaaaaagtcacttttctaaaagagagttactgaaaactataagataaaggcataaacatatggtccaatgctttaaactttcaacctgacttctgttcaatagaaataattatataagtccagtaaatactttaagaaaaaacaacattttctaaaggagagtcgctgaaagctataagataaaggactaaacatatggtccaatgcattaaactttcaacctgagttttgttcaatagaaaaaactatccaaggccagtaaataagaaagaacagcacaaaaaaatagatatggttgatagataaaataattaataaaccaaataacactttatagaaaatgttatgcctctcatagcattaattgtttttaaaaagttacacaatatcataactgagaaaaataacatatcttaattgcatcttgtgaactctcagtcaagtggtgtggcatggccatttttaacccaaatctgtacttttcctaattttatagatttaaaacacatattctaagccatttttacaaagagttttaattttaaatcagtggatatttatcatttgtttttattaatatatttttatttcaatgtaactgcctctaaacctagaaatgatatttattttacctttcagcatttgtattatttcagtttttggcacagcttaatttttattcatttcagcacagaaatattccttttatgtgtaaggtaaaaagcaagatcttagaggttataaatagaagttttcatgcttttgtgctattttcattcattgtgagtctgtcttgttattcaatagcttatttaacaaataactgtgaacacctgctacatgctaagtcatgctgctctaattgctgaaaaacagcctaagacagagagaccattgctgcactcatccactcaaatttcctcattcttagagtgactttccagggtgagtacaaatgatcagaataaattttcaaatgaaactcttagtcttgtggtcacaaagtcttaaatttttgatgttgtttatatcttcaaaggacccaagctgttgttcagcttgtgaattgcaaaataagttctaatatagcactgaaaataatggcttttatacgcaataggggcattaggttattgggcctatttgtgtatgtcactttcttgaacacagcatgcaacgaacacttcagtcatacagactgtatcttcagacaacatgaaagctcaaatatttccttctcggaaatgcagtgaggaaactgactgttgagctacatctctttttcagaaaaaaaaggaacatcttagtttttcatgattatgggggctgcattcatgaaaaaaaaataaggattatggtaactcctcttataatttaatagtctcacggagaaaagtgcagggctgagaaaaacatgaatagagaactctttcattctttcatatgttaatttattgaacatataactaagtattagcagctatgtggcaggtcatactataggtaataacatattgaccaaaacaaacagacgtggtgactgtacaggttagttaacttataaaacagtgttttcataatttaaaaatctatttgtaataaattttcctaaacttacttaaaaatattgaataaagaaaatattaatgacattcttgtttcttaaataataatatgagttgtataactattttgcatccagcagaagatctgctgacatgcttacattcctggcaattttgcaaaattcaggtaagactattttgcactgaaacagagttttaaaaactctatcactccctttgatttttaattggaaatttcaatggccttttgaatgtatattttgcaattgttgatctattttccaacatagttacaaatatgtttacctggaagtatgggaaacaaaatatttagatagattttatgtagtctattcagtttggtacaattgaaggggaacattatgtccatttgaaaatatttatcaacaattattctccaatgcatggatgtattgtttaacccatatagaaaaaaatataacagtttttcctgagctttcagggttagaagtcctgggtttgattctcagtttagccacttgcaagctatgagattttggccaactttattatacattatgggttagtaaccttaatgacactaataattgtatctaattagatgttttaatataataacaaagtaccttgtacattaaatgtccaatatatttcagtaatcactattaacattctctatgataaatttaggtaaaagtgcatcaaaacaaaacaaaacactgtcctatgagcttgtgtcctatgagatgttttaatataataacaaagtaccttgtatataaaatgtccaatacagttcagtaattattattaacattctttgtgatacatttagctaaaagtgcatcaaaagaaagcaaaacgctgtcctatgagctttatttccctgtatttattccaaagctgtattggcatatcctctacattgaggatatatcctctacttcatggtttatttttctccttaaaatcccttcttatctcttttatatattgccaaaaggaataactggcagttcctgcgtaggcagtctgaaaatcctacagtacccaaagttaattcaagtttgcaaggacttttcatattgcaaattcatgatgaaaattcaagaacttctcatactgcaaatttcttcaacttaccatgataataattaatatttgtagtactgtcaacatttaatgcagtgattatcagtaatgtttctaatagtatgaagtgcttttccataattttgcttcataattttcactttaagaaaggttacatcactagaatttcatgccatgtaactactgctaattgtgtacaatatcccatatacttatggtgatcatacatcttactttgcttgaaatcatctggatttacacctttttctttggtatagtctcaattcccagcactgtgattgagggtcacctttcatatattaaataatgcaattattataatgatatattaaaaatgcaaacagaactatttaagaaataaccaacttccttacagctcaactgcattatgaggcaagtaatatcaagtggaaatgttatagcatacagaaataggtatagtctctaatgtagaagcatttaaagtcagataattagattcatgaaacttttgttatgactgcattaatgtattttaatatagtaaacagtagcaataccattcttcatttctattagtttgttttaaaatatttattgtttaaataatttaatccatttatttgtaccaggtataaaatgatacaaaaaagtataaattaaaagtaaatctttcttattcccgaattccagttatcctatttttctctcctgtcctaagcacttcttaccagtttctactcctttcatttcaagtttgagactattgtctgactttcattttaactggaaataaaatcatagatgtttatagcatacagaaaccgtaacaatcactgaccacaaccctcatcatctgccaaagagcatagtcataaaaatgttaaatgatttgcccaaagtcagatagtgacagagctcagaattttcctggaagtgtattcaattgtttctcacacttgattgtgatcatttgttagtaataagagaaatttaagcatatgaacacacagccagaatacttgggctccagtgctcatttggtttctcattatgtttctggccttgggaaaatagactattgcctcactcagcctgcttcagagatgtatatatacccatagatagggtggagcaaatgaaaaaataaatgtgaggatactgtaaaagataagaatttgtaaaaaataaaaatgtcacaaagtcacagtaaaaataggcagtgactttatcaaaataatcgatacgatttttttttttttttgagacagactctcgctcagttgctcaggctggagtgcagtggttggatctccgctcactgcaagctctgcctcttgggttcaagccattctcctgcctcagcctcccgagtagctgggactacaggcacctaccaccacgcccagcttatttttttgtattgttttagtagagacgggatttcaccgtgttagccaggatggtcgcgatctccttacctcgtgatccgcccaccggcctcccaaagtgctggtattacaggcgtgagccaccgtacccggccaagaatcagtaggattttaaaagtatatgaggctgggtgtggtggcttatgcctgtaatcccagcactttgggaggctgatggaggcatataccttgacctcaggagttcaagaccagcctggcaacatggcgaaaaccccgtctcatacaaaaaaaaaaaaaaaaaaaaaaaaaaaagctaggcatggtggtgtgtgcctgtagtcccagctactcactagggaggctgaggtgggaggatcgctggaacccgggaggcggaggttgtggtgagccgagatcgtgccactgcacttcagcctgggccacagagtgagaccctgtctcaaaataattaataataataattataagcatatgaaagtacattaacaaaatatcctaaggtcaagtctttagtggctcatcacaaatgatatttggactatttaattatagcaatttaataaatctgtcgtcaaaatcaaaagtgactatggatacataaaccttaatagaaagagcatcacagtaaactcaggctgacatagaatgaaatttgacatgcaggagcaaagactgaaattgaacatttcagggaaggactgtctataaatgttgacattgtttaaatgtaagcaaccacgttggtgagagacaaggaacctcatctctaaacgtacatgacaagaacctagcattcaaatagcattcacaaaaggacatcataatcctattatatgtggctgacaaatttcaaaccttccaaagtctataacctacaagattaaaaaaatctttcaacatgatttttttattcaagacctcacatttgactgtcagcctaattggaaactactatagaagttcatatgatagatatcttagcacaaagtagtgctctgaaggtctagaaggggttcaagtctcaatttcacagcatttcatttccaattccacttgtataaaagcatgctaacccagcaccgacagaagcagagctacatcaagacggtacatgagtaggattcaaataaaccctctgacaggagaaatcactctcttgttcaaagtatttgtggaaaatatttgacttcaacattaacataagggacaaaagtgtctttattaagagaagagaaatgctgcaatcacatgcatgtatattcacagaaacttcgttgaatatactataaatgctgggatctaacatggtgaggcaataaacttgatctcattggctttgtattgtttgaatttgaattctggctgacttatttgctttttgattatttgacacattcttggttactctgagcctcagtttctttatgtgcaagtacaggtcataatggtacaagcacctcacagagttgatgacagctaactaagaaaacacatggaaagtgtccagcacactgttagtgttcagaacatgttaactattatcatgaagatgttcaacaatttcaaataagtgaaataatcattgcttctcttcaaaaggcattagtttcttaatttacctagatgtattttattcccttaatggccattagagaaaagcgaagaaaactaaaaaccatgagcagtgaagggaataagaagtctatttttaactttcattttaaagtcaaagctacatgtgcaggtttgttatataggtaagcttgtgttatgggggtttgttgtacagattatttcattaccaggtattaagcctagtactcactagttattttccctgatccttttcttctgttggaaggtttatttaaatcctactcatgtactgttttgatgtaccttccaccctccaccctccaatagaccccgtgtcttttgttcccctctgtgtgtctatgtgttttcatcatttagctctcacttacaagtgagaataggtggcatttagttttctgttcctgcatgagtttgctaaagataatggctttcagctccatccatgtgcctgaaaaggacatgatctcattcatttttatggctgcatagtactccatagtgtatatgtaccatattttcttttttgaatctactgttgatgggcatttagtttgattccatgtctttgctattgtgaatagtgctgcaatgaaaatacattttcatgtttctttatgactggatgatttatatttctttggatatatacccagaaatgggattactgggtcaaatagcttttctattttataggtctttgaggaatctccacactattttctgcaacagttgaactaatttacactcccaccaacagtataagcatttctttttctctggcagcatttgttattttttgactttgtaatagccattctgactggtgttagatggcatctcattgtggtttgatttgcatttctctagtgatcagtgatgttgagcttattttccctatgcttgttggccacatatatggtttcttttgaaaagtgtctgttcatatcatttgcccaatatttaataggggttatctgttttcttcttgtaatttgtttaagttccttatagatgcttgatattacacctttgctggatgcatagtttgcaaagcttttccccattctgtaggttgtctgtttatgttgttgagagattcttttgctttgcagaagctgttaagtttaattacatcccatttgtcaatttttgctttttctgcaattgctttgacgtcttcatcatgaagtctttgcccattcctatgtccagaattgtattgtttaagttgtcttccgcagttttataggtttgggttttacgtttcagtctttaatccatcttgttaatttttgtatatggtgtacgaaagggatccagtctcaatcttttgcatatggctagcctgttatccaagcaacatttagaaaaataagtcttttaatgattgattagctcgttaattggagatgcatgtaagaagtagtaactcagatactcaacaaatgagtacctgcagaagaaacaaaccctgaatgatattagtcactagacaactgagcaagcttacatgagtgccttttgctatctgaaaggagaaccacactagccttcgtatatatccatctgcttacccctactgcacattttgaaacaacataatactcttcttgcgtgaaaacagggtgaggttgggtgaggtggctcacacctgtcatcgcagcactttgggaggctgaggcaggtggataccttgagtccaggatttcgggaccaatctggacaacatgttgaaaccttatcccttcaaaaagtacaaaaattagccaggtgcagtggcgagtgcctgtagtcccagctacccaggaggctgaggcaggagaattgcttgaacccaaacttgggaggtggaagttgcagtgagtcaagattgtgccactgcattccaacctgggtgacggagtgagcccctgtctcaaaaatcaataaataaaaaagaaaagaaagaaagaaaggagggtggctcagaaataaaatatagactggcaaatatatgttttgttttgataatgttcaatctaaagaaaaccatttctaacttaaagataaggaaaatagtataacttgaagatgtacctttcattcatactcaaatatattaatcagcgcccttttacatttcttcccttctccattgtcacaacgctaacccaatgtaccaccttgcaaaaccctcctaaatgcttctactttagttggcttaccatctaaattccgcatacgggtcaaagcattcacttagcaatttaaatctcatgatgtgattcccctgcttaaagaccctctattaactttccactgtaatcagaaaagagaaaaataaatgaacaacaacaccaccattaaacattaaagccaattaatattaaagtctcataggtatcaatcctttcccatttgtctgatttcatctcaaaatactctctcgctctagtttattatactccatcatgatcattatagtccagccaaacaagtctttttattcttcagaataccttgtaagtttttgtaccttttattaaaatcctattttaatgaaaatctgcttctcaaaattttcattgagttaccattaacttgcaatttaagtaggtgctcctcatagaaattcttgacttcaaaatctaagtttccattttctctctctctacctcaataagactctgtttgcttcttcattgtttttaatcactatttgatttatttttattttgttttattattattattattattattattattattaatattttgagacggagtcttgctgtcttgcccaggctggagtgtaatggtgtgatcttggctcactgcaacctccacctcccagattcaagcaattctcctgcctcagcctcccgagtagctgggattacaggtgcatgctgccatgcccagctaattttttgtattttaataggaacaagagtttcaccgtattgcacaggctggtctcaaactcctgacctcaggcagtccacccgcctcaacctcccaaagtgctaggattacaggcatgagccaccccgccttgccatttttatcactatttgaaattacatttatacaataatttgtttatcattattgttcagcatagcatcccctatatttaatcacaattgattagtaagtttccattaatatattattaaatgaatgaacaaataggtctgaggaaatgaagtaaagataaatagattttatattgtcggctaccctgtgctatcgtcagacaagggcctacactgtagagactcctgggtccaaccaaaatctcagacaactttttattattccttcttttaatttatcatttggtctttaatcttttcagctacttctttcctttagtggttgtaatttttttcccttgatttctgtattttggtattccatgcaattgttaagaacaaaacaaaataaaaccaaaagaaacaaacaaaaacaccctgatgcttttcttcctgtaatactactagttgagaataaatttgaattttgtcattattttatttccatttttcaagttattaataaggttgaataatttttcttatgtttctcggaaatttgtttttactcaagaagcaatttgagccctgatttcctttcctggttccctgacagcacactctacaagttgctgtgggaagcttgaagactggcatacagaaagcatggttgcagtgttctcagaactgaggcccaaccttttcttcctaacctcttcccctattctgaacgctagaatccctttcttctcctctcccctttctccatgatataagccattgacttaaaaccttgtcctaccaacttagactgctttactttatatttctccttttcaatcctcctactggagaaattcaagccaaaagaactcaagttgcattcacgagattctacttatctttcctcatcttattgttatacctattttatttttatttgcattccattctttaaatgatctttcatttattaacatatacacattttaagcttattatcaattaatgcttgttctttatattttagggctcatattaccaggttttaaatgttttgttttattaacttgggccttttattttatttatcttaactacatcttctttttaatcgtttgcattctgtacatttcatattttaactcattcaagtgtcttaataattatgaaaggtatttaaaaagatgctagatacaaaataaaaattacatattcattcaaatgcatccatgtgtaattttgttctttaagcaataattatctttaattatattttgttctgtattttattttttattttattttactttatttgagacagggtctttctctgtttccctggctagagtgcagtagcaaaatcacaacatgctctaacctccacctcctgagctcaagtgatcttcccacctcagcctccagaatagctgagacaataggtgcacccacaaagcctgattaatttttgtattttttgtagagatgggattttgccgtcttgctcaggttgttctcaaactcctgagttgaagtgatccacctgtctcggctctcaaagtgctgggattacaggcttgagccaccatacctggcctatttagtctactttaaattgcaaacatccacttatcactctcccttctttgttctaacgtgtaccgtgtagaatattacaaaacacagagacacatacaactgaaattaatacacataatgtatgtttttttatctttttgttatgtatgtatatacatttcaaattcgtactaatgttatcatatttggcaggtctgaaaatggaaatattctctcctatatcatattgcatcgtgtgtgttctagaaaggtcacttatggaggctagtattcattttagaaagcatgctatcagtgttcttcattctgcctattggatggattgaacttcacaaaaccctgtctttcacttaacactagttagatacaagattaaattttgataaatgtttgattcccagagtagcttgtctatgagaacatttcagttgacagcatgaatcactcattaaatcaggtattgaatcacataaaaccacaaagcagagcagtttccaacggtaattaaatcacggtccgtgaaatcacgttctagagctggagctaattactgctttctgtgactactgctgcaacatggtcactggagcacaggaataaagtcaataccggatttacccaaagttagatggtttttaagagttaatatgtggaaagttctgaaatgtgtggctgaagaccatgtgactatataaaaaaaggaggccatagtactttaaaaaccttcctaccaacccataaaaatatgaagtgactgataactacaaatgttgtcatttataatatatatattttatgcccactttacgtccactgtctatgttgctcaaagacaatccatatttcacttttctatctgccactacattaattctatggagagaatataataaatgccaagttattatctaacaaatggacaactcaatatatgccattatttgaattttaatccattatagttgcctacttagcatcaattgtgctaaacaaaatacattatttgagaaagcaaggggtaactcagatgaacaatagataaataattaaaatgtatatctgcaaagtcacaaaggcttattccactgtatgtctcttgccagctgtgtgaagatcttaggaaggctgaatgcctgtttagagttacaaattttcttgcttataattctgatattttctgacattactgacattaatctatatttgagagagatgtaatgaagtttaagaacataatgcctgtaaaatacttagcaattgaaacacaggcactgataaatattgctggacatacaataagcacctaataaatgttatttaatgatcttgttgaaacaatcataatattgcatgcgattttaaaattatagacataattttaaatagaatagatgaatagaaataatatcataaaactgaggctaaatatccacttggtaatgcaaatgtttctgaatgtattgtcatacaaaaaattaaaaaaaaaaattagttgaattggaacaacttattcctgattacatattcccactgttcagctctactgcagattgtatcaccatagagttcaatgtaataatagaatacacataaaataaagcactacagtctcatatgattcgtgaaaatattatgctttttagaaatttccttttcaattttctcacctattactacattaaatagtctcagtttattgatctgggcaaggagggttaacccaagcactgatatcatatatgaatcattactttattcaatgtgcacaaaagtatttattgatattattaatcaaatggcatttttcctaaattgatttggtttataatattaggaaggtttaggtttgaaaactgaaggcctacacttactattgctcacttactatctgcataaccaagtgcaatgccttagtttccacatctctaaattgaaaggaaaacacaaacatgtagtttgggtttatattcaaagtcaaatgagctaattttgtgaaaggaccaagtattatgtataattaatttatacaatatattatagatcacaaaattctaagaaatatatagataattcatatttctctgaatttcatataggtgccagcaaaaataggtttaatgaatacctttcacaagaaaaatggataataggggaagcaaaataaaatgagaagaaaattagaaaacaattgttttcaaaaaaacgattttatatgctaagaagtttctcatggactaatagtatttgatagtgtttttgaaaaataaaactaattgtagttgatacaggagaaaaaacaatacaatgaagaagtgatagccatttcaacttagggcatatagttatggagtaactgaacaccacatcaaaaaaaaatggaatctaggcacaggccttagactttcacaaaaacaaaataaaaattaatcacagtcctaaatgtaaaatgcaaaattacaaacttcctagaagaaaaaaaggagaaattctcgataactttggggttggcaatgattttttagatacaaagccaaaggcaaattctatgaaaaaaattgatgaactatactatattgatattaaaattttctgttctccataagacaatggcaaaaaaatgaaaatataagtcacagataatatttgagaagacacatctaataaagtaatgttaggcaaacatacatagaaactttaaaaactcaacaaaaagtaagacatccaatttataaaaagcgaaaaaccttaacacttcaccaaggaagatacatagttgtcaaataagaatatgaaaagacattccacatcatatatcacaaaggaaatgcaaattagaacaacaagtagatgctactatatacattttggaatggtcaaaacccagaacattgattatgctggcaaggacatggagaaacaagaactccctttcactgctggtggaaatgcaaaatgttatagccactttagaagacagtttgacagctttttacaacattaaacagccttcaccgtatgatctagcaatcacactccttggtatttacccaaaggaattaaaaactttcattcatagaaaacctgcacaaagatgtttatagaacctttattcataattaccaaaatgtggaagcaaccaagatgcccttcagtagattaatggataaactgtgctacatctagacaatggaatatattactcagggcactaaaatgaaattagctactggccagatgcggtggcttacgcctgtaatcccaggactttgggaggccgaggagtgggggatcacgaggtcaagagattgagaacattctggtcaacatggtgaaaccccgactctactaaaaatacaaaacttagctggacatggtagcgagtgcctgcagtcccagctactcaggaggctgaggcaagagaatcacttgaacccgggatggggaggttgcattgagccaagatcgtgccactgcactccagcctggcaacagagcaagactcattctcaaaaaagtaaataaataaaaattaaacaaaagataaaaaagaaattagctactaagctgcaatggactaatctttcttctccaaaatgtcaacattcaaatattaaatccttaccccaaggtgatggtattaaaaggtggggttttgggaagtgatcaggtcatgagtggagctctcatgaatgggattagtgcccttataaaatattcccaagataactcttttgtcctttccaccatatgaagacacaatgagaaagtactctctatgaatcagaaagctggtcccactgacatcaaatctgctgttacctttatcttggactttccagcctcccaaactgtaagaaataatttttgttgtctataaactacccagtctattgtattttgttatagccatcagaatagactaagacatgagctatgaagagaaataagcaagtatattactaagaagccaatatgaaaatgttacatgctgtatgattccacctatatgacatgctgggaatgtcaaaactatggagacagtgaaatgatcagtaattgcctgaggttgaagggaaagatggataaataggcagagcacagaggatttttagggtagtgaaactattctgtatgatgctataatggtagacacatgtcaatataaattagtccaaacccatataatgtacagcactgagaatgaaccctaaggtaaactgtggactttgggtgataacgaagtattactatagactcatcaattgcaacatatgtaccactctagtggaggatattggtaatagtggaggttgtgcatttttggggcagggatatatgggaaatctctgtaccttcctctcaattttgatgtgaatctaaaactgctttaaaaaatctttaaaatgatagtggccaatatttttggacactataataaaagatgtatgtgaattgcctcatttatccccaaaacaaccctatgaaatacatatcattttgaatctcatcattatgagccccatattggctttacaatacctcagtttcagaacagctattcaaattgtccaagggaacatttggtaaattgtccactcaaacttgtgttgtgtgactccaaaatccatacttttaatctctataatttactatgcctctattttttgttaactgaaaatgtacataagtagactctcctaataattttctgaataatactttctacaacttaaaaaacctggacgttttataaaatacagtttctcttagccagtaaaatttttctagcagtgtcatataaagtcattataaagcagtggcatagtatatctcaacattcctaatctctctattttttcctctcacatttcaattctgaaacaatatatctgtcacttgtcagggtggtagtgagaatacaattttatataaacattgaaactctctgcagaatataattttattgtgccatttttccctcatactagttgtaaggcactaaagaatggacatggggagaattaccatctttatctgtatacatggggagaattactatcttttttctgtatatgtgtgcatgtttgtatgtatttctgttgaagagggcatatttcttgtattattaaaattaattggcaggtttactgaaaagtagaaccaacagatacgcataaacattataaatcacattaacagtattcaaatcaacctgtttatttcattttatgatattacaagtcaagctccccataaagctgtccaaattatttctgcattcacacatacttcataatctgacactcaaataaaaagattcatgcttctgggactccaaagttatcagaaggtaaacaaacaactagtagaaagtatgctgtttatcctgtgataaaggctgttggcttgaatatttcacattttgctgggatcaaatcaggatattaaatattttgtttcatgcctttagatgaagcaatcctgagtcaagctatgcagcatgatcatgttatgtacaaggaatagttcctattttgccaggtttctacagttgtgagaatctaagcagagaagcacttccagaaagcaatgggaaaatattagtcaccataaatacatatggaaaaatctcctaatgaaaagattctcaagcaagtgttctattagagattatttttgactcttcttagggcctgacatacaagtaattatctaggagttactgctactagcactataattactaccactactgctacttgtgtaaatgactggatttactcatcaaaataacttaattgattgacactttcaacagatttaatagattatctgacatcctgtagataaatgcaaagtctgctgctacctttcctttcagccatggtagtgacaatgtaacatcatgcctgaaatcccttgcacgtgcctgaaaagcacacatgtgtgcacacaaaggtactcatattaggttggggcatataatctctattatatgctgagaaaaaaattgaaatcattgtcatttaattaataagtgtctagtttctgcacctctgattcttaaaatataactttttttttcactgaggggatagctacttatactaaaatacctaaatctgttagcagcatatttttctcaaaaaggtactatgagccaaaagacctaggatgtcaaaagcaaatcaagcataatgtagttacgagttttcatttacttctaattctcttcatcagtaaagctttgtgataattttgatagtaccaatttatacttgtgaagcaaatgaaaacaaagacattttaactgtgagtgaaaataacaaaggtgctaaactattatcatttgagacatcataagcacaaacgattatttttgggtgactttttaacaggctcccaaatcattatcacaataaatagaatattttaaaaaatctcaatgagatgttatttttctttatcatctgtcctctccttgcagtttaatagcaaaatatctggatgaaagatgaaaatattcagccagctaattagaagggctgtccacaggaagctcagcaataggacttgtctacagatgtgagacacaaataagaatcacaatttaaaaatagaagacaaataatgtcactcccctgatttcttgctacatttaaaataaatacaaattccatatctagaaataaagtttcctgtctatagctctgatcttatctcctaccatctacttccaatccccattcttatcctctagcacaatgtcctaatctgttcctcaaattattgaactccttttcccctttcatctaaccagaaaatgtaatgctcaccctttcccccagttatggtaatgttgactttgaatcattcaggtttcggttcaaaggtcccctccttagaaaggtcctgttgtatgactctacagtaaggcaacctcagcactatccagtcactatcatgtctatcactttgctttgactttcttcaaaacacatactgttggcttaaatagtcttgtatgtatctgtttacatgctttttaactgttttaccactctatgaacccaggagagtagatactgtttccttaccaatgcccttctgcccagcatctagaagagctcctagaacttttaagaagtcaaaattatttgtgaaataagtgaaataacaaaaatagtggattcttagtatactgttaataaaaactaaagctccattagaatagttagaccagtttatttatagtctatgctgtttgtttagttttctacaagttctttggcttgtctttctccttcttaaactttaaagttctctagacaatgctcagatacgtgctatttcataccgactaagaataatttggttaaatggagattaaaaactatgtcgtgattgtgattcagtttttattactgttattgattgctttggtcaaaatacaaaggccactttatacatacaagtcccactattccccaaacacagtattttccataatttattaatttttatttacacatttatttttgttcacatatgtcaggaattttttttgctttatttatatgctatttacttatcacaaaaattgtcagcttattatatttttaatcgacgtataagggtattttcttaaaactttttttttcttaacagcagttctctcttatttctcccttaatatctgtttctttcaccaggataaatgtgtgtgattttattttaatttttaataaaagaatcaattctctggttaatcagttctacttttttaaattaattaatttatatttaagttttttactgttctcttgggattgatttgttttattctaagatctgtaagtgaatgcaaaagtaacatttatttttttttaatttgagttgtttctaattagagattggattgttaatttgatatgcagtgttctctgtatcacattttataaatattgttcctttctctcaaaactatttttttaagttttcacaaattacatgaggcttttattttattttattaatttataaatttatagtcttatttgtgagtcttgggattgatttattttattctaagatctgtaagtgaatgcaaaggtaactttttttttaatttgagtatttgagttatgtttctaattagagattggactgttaatttgatatgcagtgttctctgtatcacattttataaatattgttcctttctctcaaaactatttttttaagttttcacaaattacatgaggtttttattttattttaatttattaatttataaatttctagttttatttgtgagtgaataaagttctaatgttcgatagcagactacagtgactatgcttaatattttttatactacaaaataactaaaatgagaacttgaaattatactaatacacaaaaatgataaatattcaagctgttgtataccccaagtgctctaacttgatcattacacattctatgcatgtaataaacacatctactccataaatatgtaaactattatgtatcaacaaacgaagaaaagagagacatgaaagaggtgatttctctcttgaccatgtgaggatataataaaaagatggctgtatacaaaccaggaaaggtataattatagttactctagtctgctatcaaacattgtaacttatttcttctatctaactgtatgactgtactcattaaccaacctcccttcatccccacaacacttctcaggctgtagtatctaacattctactctgtgtgtccatgagatcaagttttttggttctcatatatgattgagaatatgtagtgtttgtctttttgtgcctgtctcatttcacttaatataacctccagttccattcacgttgctgcaagtgacatgattttattctttttaacaacagaatagtattccattatgtatatataccacattttctttattcactcattcatgggtagacacttaggttgattccatatctttgttattgtgaatagtggtttgacaaatatgtgagtgcaggtttctctttggtatattgatttatttttctttgaataaatacccaaatacccagtagcggaattgctggataatgtgatagttctatttttttttttttttgagaaacttccatgctgctttctatggtggttgtactaatttacattaccaccaacagtgtataagagtctaattttctccgcaactctgccagcatctgttactttctgtctttttaataacagtcattgcaactggggtaagattatattttattgtggttttcatttgcatttccctgatgattagtgatgatgagcattttttcataagcctgttggccatttgtatgtctttttttgagaaatgtttattcgtgtcctttgccaatttttaatgcgattatttgttttttactgttgacttgtttgaatttcttgtatattctgaatattgttctcctgtaaaataggtagtttcaaaatattttcttatatttaaaaagttgtctctacagtctgttagtttggctgtgcagaatctttttactgtaatgtagtgcattttgtccatttttgttttatttgcctgtacttttgaggtcttagctgtaaattctttgcctactctaatgtcctgaagagtttttcttatgttttttgttatatctttgcatcaacataatacttgtatagtttcagatcttatgtttaagtttttaatctattatgagtttatttttgtatatgatgggagataggggtctagttttattcttctgcatgtagttatccagctttccaagataaattcattaaagagactgtcctttccccagtgaattttcttggcaattttatcaaagatcagtttcctgtaagcatgtagatttcattttgtgttatctattctcatttatgcatacatttttatataaatgccatgctcttttgttcaccataggcgtgcactatgctttgaaataaggtagtatgattccttcagctttgttttattttgctcaggatttctttggctcttctggatatttttttgtttcaaatgaattttaggatattttttatttctgtgaaaaatgatagtgctattttcatagggattacattaaatctatatatttcttggggcagtatggtcattttaatattaattctaccactccaagaccttggatgtctctccatttgtttgtattctcttcactttctttcatcattgtgtgtgtgtgtgtgcgtgcacgtgtgtgtgttccctacagatctctttcacctttttgattaaatttatgagtaagttctcttttttgtagctattgtaaatggaattgccttctctgctccttttttggttattattatttttgagacagagtctcactccaacacccaggctagagtgcagtggtgcagtctgggctcactgcatcctccacctcctgggttcaagcgattcttgtgcctcaccctccgaagtagctgggattacaggtatgttccaccatgtccagctatttttttttttttttgtatttttagtagagataggggttgccatattggccaagctggtctcgaactcctgtcctgatgtgatccacccaccttggcctctcaaagtgattacaagcattagccactgcacccagactgtattatctttttgatgttctgttagatttggtttgctggtattttgtttttttttttttttttcatgtttaaaataacaattttttttttatactttaagttttagggtacatgtgcacaatgtgcaggttacttacatatgtatacatgtgccatgctggtgtgctgcacccattaactcgtcatttagcattaggtgtatctcctaatgctatcccttccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttggcttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgaggaaccgccacactgacttccacaatggttgaactagtttacagtcccaccaacagtgtaaaagtgttcccatttctccacattctgtccagcacctgttgtttcctgactttttaatgattgccattctaactggtgtgagatggtatctcattgtggttttgatttgcatttctctgatggccagtgatgatgagtattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttcttccattctgtaggttacctgttcactctgatggtagtttcttttgctgtgcagaagctgtttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacctatggctagccagttttcccagcaccattttttaaatagggaatcctttccccattgcttgtttttctcaggtttgtgaaagatcagatagttgtagatacgtggcgttatttctgagggctctgttctgttccattgatctatatctgttttggtaccagtaccatgctgttttggttactgtagccttgtagtatagtttgaagtcaggtagcgtgatgccttcagctttgttcttttggcttaggattgacttggtgatgtgggctcttttttggttccatatgaactttaaagtagttttttccaattctgtgaagaaagtcattggtagcttgatggggatggcattgaatctataaattaccttgggcagtatggccattttcacgatattgattcttccttcccatgagcatggaatgttcttccatttctttgtatcctcttttatttcattgagcagtggtttgtagttctccttgaagagtatccagccaaactaagcttcataagtgaaggagaaataaaatactttacagacaagcaaatgctgagagattctgtcaccaccaggcctgccctaaaagagctcctgaaggatgcactaaacatggaaaggaacaaccagtaccagccactgcaaaatcatgccaaattgtaaagaccatcgaggctacgaagaaactgaatcaactaatgagcaaaataaccagctaacatcataattacaggatcaagttcacacataacaatattaactttaaatgtaactggactaaatgctccaattaaaagacacagactggcaaattggacagagtcaagacccatcagtgtgctgtattcaggacacccatctcatgtgcagagacacacataggctcaaagtaaaaggatggaggaagatctaccaagcaaatggaaaacaaaaaaaggcaggggttgcaatcctagtctctgataaaacagactttaaaccaacaaagataaaaagagacaaagaaggccattacataatggtaaaggaatcaattcaacaagaagagctaactatcctaaatatatatgcacccaatacaggagcacccagattcataaagcaagtcctgagtgaccaacaaagagacttagactcccacacaataataatgggagactttaacaccccactgtcaacattagacagatcaacgagccagaaagttaacaaggatacccaggaattgaactcatctctgcaccaagctgacctaatagacatctacagaactctccaccccaaatcaagagaatatacatttttttcagcaccacaccacacctattccaaaattgaccacatacttggaagtaaagctctcctcagccaatgtgaaagaacagaaattataacaaactgtctctcagaccacagtgcaatcaaactagaactcaggattaagaaactgacttaaaaccgctcaactacatggaaactgaacaacctgctcctgaatgactactgggtacctaacgaaatgaaggcagaaataaagatgttctttgaaaccaacgagaacaaagacacaacataccagaatctctggaacacattcaaaacaatgtgtagagggaaatttatagcactaaatgcccacaagagaaagcaggaaagatgcaaaattgacaccctaacatcacaattaaaagaactagaaaagcaagagcaaacacattcaaaagctagcagaaggcaagaaataactaaaatcagagcagaactgaaggaaatagagacataaaaatcccttcaaaaaattaatggatccaggagctggttttgtgaaaggatcaacaaaattgatagaccactagcaagactaataaagaaaaaatgagagaagaatcaaatagacgcaataaaaaatgataaaggggatatcaccaccgatcccatagaaatacaaactaccatcagagaatactacgaacacctctacgcaaataaactagaaaatctagaagaaatggataaattcctcgacacatacaccctcccaagactaaaccaggaagaagttgaatctctgaatagaccaataacaggctctgaaattgtggcaataatcaatagcttaccaaccaaaaagagtccaggacaagacggattcacagccgaattctaccagaggtacaaggaggaactggtaccattccttctgaaactattccaatcaatagaaaaagagggaatcctccctaactcattttatgaggccagcatcatcctgataccaaagccgggcagagacacaaccaaaaaagacaattttagaccaatatccttgatgaacattgatgcaaaaatcctcaataaaatactggcaaaccgaatccagcagcacatcaaaaagcttatccaccatgatcaagtgggcttcatccttgggatgcaaggctggttcaatatacgcaaatcaataaatgtaatccagcatataaatagaaccaaagacaaaaaccacatgattatctcaagagatgcagaaaaggcctttgacaaaattcaacaacttttcatgctaaaaactctcaataaattaggtattgatgggacgtatctcaaaataataagagctatctatgacaaactcacagccaatatcatactgaatgggcaaaaactggaagcattccctttgaaaactggcacaagacagggatgccctctctcaccactcctattcaacatagtgttggaagttctggctagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaaatcacaagcattcttatacaccaataacagacaaacagagagccaaatcatgagtgaactcccattcacaattgcttcaaagagaataaaatacctaggaatccaacttacaagggacgtggtattttgttaagaatttttacatctatcttcatcagggacattggcctgtagttttctttctcgttgtgcctttgtctggttttgatatcagagtaattccagcctcataaaatgagttagagagagttcccccctcttcaattttttataatactttgagaagaattggtattagttattctttatacatttgggagaattcagcagagaattcatctaaccgtaggcttttttgggggggagaatttttattactgatttattctcactacttcttttaagtactacttttcctaatgctcttgctcccccccatctcccccgaccaggcttcagtgtatgttgttcccctccctgtgtccatgtgttctcattgtttagctcacacttgtaagtgagaacatgtggtgtttggttttctgttcctgtgttagtttgctgaggataatggcacccaggtccatctatgtccctgcaaagtgcatgatctcattcttttctatggctgcatagtattccatggtatatatgtactatattttctttattcagtctattattgatgagcatttgggttgattccatgtcttcgctattgtgaataatgttgcagtgaacatacacgtgcacgtatctttgtaatagcatgatttatattcctttggttatatacccagtaatgggattgctgggtaaaatggtatttctggttctaggtctttgaggaattgctacagtatcttccacaatggttgaactaatttacatttccatcaacagtgtaaaagtgttcctatttctccacagtcttaccaacatcagttgtttcttgagcttttaataatcaccattctgactggcatgagatggtatctcattgtgggtttgatttgcatttctctaatgatcagtgatgttgagctttctttcatatatttgttggctgcataaatgtcttcttttgagaagtgtctgttcatgtcctttgatcactttttaatggggttgtttatgggggtttttttgtaaatttatttaagtttcttgtagattctggatattagatcttttcagatggatagattgcaaaaaatttctcccactctgtaggttgcctgtttgctctgatgatagtttcttttgctgtgcagaagctctttagtttgattagatcacatttgtctattttggcctttgttgcaattgcttttggcgatttcctcatgaaatctttgtccatgcctatgtcctgaatgctattgcctagattttcttctaagatttttatgtttttgggttttacatttaagtctttaatccatcttgagataatttttgtataaggtatatggaaggggtccagtttcagtttcctatggatggctagccatttctcccagcaccatttattaaacggggaatgctttccctattgcttgttttagtcaggtttgtcaaagatcagatgacgtagatgtgcggtcttacgtctgagttctctattctgttccattggtctatgtgtctgtttttgtaccagtaccatgctgttttggttactgttattctcactacttcttattgatctatttcaggttttctattttttctttatccaaacttggtagggtgtgtgttttcaggaatttttccatttcctctagggttatgagaatatggtgttcataacagtctctaatgattccttgtatttgtgtggtatcaattgtgaggctcaattttgtttcttgtttatttgagttttgtctctttatctttgttagctctataacagattatcaattttgtttaaattttttttttttttttttgagatggagtcttgctcagtcaccaggctggagtgcagtggtgcaatctcagctcacagcaacctctgcctcccgggttcaagcgattccccagcctcagcttcccaaatagctgggattacaggcatgtgccaccgtgtccagctaatttttgtattttagtagagacggggtttcaccatgctggccaagatggtctctgtctcctgacctcgtgatctagccgcctcaggctcccaaagtgctgggattacaggcataagccactgtgcctggcctgtttaaacttttcaagaatcagctttttgttttactcctcctttgtattttttttttcagtctttatttcatttacttctgctctgatctttattgtatcttttcttttgctaactttggatttgttttgttcttggtttcctagtttcttgagttgcatgattagatttttatttgaagtctctttatttttgatgtaagtattcagtgttataaactatcccttatagtactgcttttgctgtatttcacaggttttggtaggtggcattatcattttcatttgtttcaaaataatatttgattttcatgttaatatctatattgaaccagtggtcactcaggagcatgttgttttgtttctatgtatttatacagtttccaaggtttttcttggaattgatttctagttttatttcatcgttgtctgagaagacacttgacatgattttatttttaaaaaatgagacttgttttgtaatctaacatatggcctattctagagactgttccatgtgctagtaagaagaatgtatattttgcagttgttggataacatgctctgtaaatgtctgttatgttcatttgctctaaagtccaatttaagtccaatgtttctttattggtttatttcctagacgatctgtctattactgtattgaagtccatctttctctttagttctagtaatatatagtttagctctataaatctgggttctccaatgttgagtacatatatatttagaattatatcctcttgctgtgtttttttttttttatcttcttggtgactctttttttttggagacagtgtctcgctctgtcactgagcctgtagtgaagtggtgcgatctcagttcactgcgacctctgccttcaaatggttcttgtgcctcagcctccaaagtagttgggactataggtgcacaccaccatggcggctaattattattattattatttttggtcttttagtagagatggggtttcaccatgttgcctaggctagtatcaaacttatgaactcaggcaatccactcactcagcctcccacagtgctaggattacaggcatgagccatcatgtgtggcctgtgacctttttttttttttttttttttttgagatggagtcttgctctgttgcccaggctggagtgcaatggggcgatctggctcactgcaacctctgtctccttggttcaagcgattctcctgcctcagcctcctgagtagctgggattataggcatctgccaccacgactggctaattttggtatttttagtaaaaacggggttttgccatgttgatcaggctggtctcaaattcctaacctcgtgatccgcccgcctcagcctcccaaagtgctgggattacaggcatgaaccaccacgccagccaagtctttttatctaatataagtatagctactactcctttttttttttggtttttatttgagtggaatatctttttctgtcactactttcagtctatatgtatctttacaattatactgtttcttgtaggcagcctataattgtatcatttttaatccattcagctcatctataacttttaagtgaataatttaatctatttacattcaaggttattggtatgtgaggttttcttcctttcacagtgtatttgtctggttgttttgcatgtgtattcaatgttcttttctttttatcttatttttttgtccctatggtttggtggttttctctcttccttccttccttccttccttccttccttccttcctttcttccttccttcccttccttccttcctttccttccttctttcctttccttccttctttcctttccttccttccttccttctttccttccttccttcctttcctttctaccttcctttccttctttctttgagatggaatctcattctgtcacccagcctggagtgcagtggcacaatattggctcactgcaaactccacctcctgggttcaagcgattctcctgcctcagcctcccgagtagctggtattaaaggcatgcgccacacctggctactttttgtatttttagtggagacgcggattcaccatgttggacagactggtctcaaacttctgacctcaggtgatccacctggcttggcctctcaaagtgctaggattacaggcgtgagccaccgtgcccggccagtggttttctctaatgatatcatttcagttttttctcttctttatttgtgtcattactttgcgagtgagttttatacttttgtatattctcatgatggcaactcttgtcattttacttccaggttcagaacttctttcagcatttcttgtaggactggtctggttgtcatgaatccatcagcatttgctttcagggaaaggctttgtttatttttcatttatgaaggatcatttttctggagttagtatccttgggtagaatttttttatttcagcactttgaatatattaccccattctctcctggcctgtaatgtttatgttgagaagtccactattagtcttatgggagtgtttttgtaaatgactagatgattttctcttgctagttttggaattatctctttgtttttgacttttgagagattgactatattgtgctgtggagaagatattttggcattgcatctgtctgggggattgcttggcctcctgtatctggatgtctaaatatattgctagacttgggaagttttcatctattattcatcaaataggttttccaactttttcattcttcatcctctgaaatactgataatttgtatatgtagtcactttatgatgacccatatattatgaagtctttattcgttcttttttattcttttttctttatttttgactgactgggttatttcagaatacctgtcttcaagttctgtgattttttttcttttgcttgagatagtctattgttgaagcccttgaatataatttgtattcttttatttcaatagttttaggggtacagctcatttttggttctgtggataaattttttagtgttgatttctgagattttagtgtacctgttacctgagcagtatacactgtaccaaatacgtagtcttttatccctcacccccttcccaaaccccccgtggatccccaaaatccattatatcactcttatgcctttgtgttctcatagcttagctcccatttatgaatgaaaatatatgacatttggttttccatttctgagttacttcacttagaataacgacctccagctccataattttcattctattcaatgagttcttcgcttccaggatttctttccttttataatttctctttggaaaatttctcattgtttctttgtattgtttttcagaattctcttgtatctcactgagcttctttaaaatcaatatttagaatccttttttattctgggattttgggactttcttttttattgtgatgtgttgctagagaattattgtgttcttttgggtatatcccacttccttactttttattgttttctgtgtctttatgttgatatctatgcacctgttgtaatgctcacttcttccagtatcctgaatttgctttctttgggggatgtttttgtgaagatgaatccatgttttgtagggtcatttagctttgattctgcatgcattcagtaatgtagtctctgtatgatttctttggccttaaacatcacctgtaactgtgatgtccttggtgacttagaatgtggttattaatggaggctctggtaaagtgtaaagtgttgctgggaacagacattgcaggtagtccagtctttagccccagtcatgacaactgtgggctgatcatgcctgcccttgaaccccagtgtagcttattgataccaccattaggtggtccaggcaggccaattctcaggcctccagatggcttcctcagatgccagtagtgacaacagtgggccaggtgggcaggcaggctcttaggcccctggacagctagtgtggcatgggcaatggcagtaatgggatgactctctgggttctaaacagtgaacgtttgtgttggcagtggctttaatggactggagaggttggtccttaggcttctatatggtgcgcgtgagtgatcctgtcttcaggttcatgaggaaagtgtgctgatgccagaggtggtgcaatagctggagtgattcccaggtcttcagaaggtttgctcaggctctggtggggagggactggtaaagataaactgatggtgtttgatctcaggccccaggtagtgtgcaggggcttaggctctagtaggtagaacaggggattctgtggtggtgggtttgaagaatctggcctcagggctcaggctacaacatagcagtcctgctatttgtgttggtggggttgtcttcagcagtcccatgcaggcatctctcaggttctagggagtgcacactttgtctccagcaggagccatggccacagcggtgtgcacagggaacctgtactcagagggtgcactagagcaggggttcccaactccttggctgtgaaccagtatgggtccacataacaggaggtgagcaacagactagtaagcattaccagctgagctccacctcctgtcagatcagcagtggcattagattctcataggagtgcaaaccctattgtaaactgtgcatgtgagggatgtaggttccacaccccttatgagaatctaactaatgcctgatgatctgaggtggaagagtttcctcctagtctgtggaaaatttttctcccaagaaacaagtacctggttccaaaaatgttgggtaccactgcactggagtacagaggtcatgctgtgtgagcagggttggcactcccagctccaaataaggtgccatctgggagtcctgggtagtacattatttggtccctggctgctgcagtaattgcagcattgtttggagtccaggagggatctcgtcctttgcacacacaggcataagcatggagactgtgctaccagagtgggtaagatcatcacccacagtcccagacaggcagccctccagctcacccaccccagtccctggcagcatcaacagcattatggctacagtggtatgcagaagcaaggaagggaccctgctcactttctacatgtgagccagagtacaaatgctgctctggtatggagggtggggttgctgctcccagccccagacagtcagttttcaggcttgcccacctccactcccagtggcaataactgctgtagcagtatgcagaaagggaaaaggaacccattgttagataaacccaaacagaatctgtgctgctgctgctgggggtggggtcacttttcatagccccagacaaggagctttgggggtctccagatcagtgcccatgctagttttagtattcatgtgcacagaggaggcttcttatggtcaggattgcagccgtcaatagtggaatgcaatggggatccccttcaggctcccagctgatctcagccaagctggccactttcttccatctccttctctgcctcagatgtttcctatgttgagcttcagtgttctcttttagatgttctagttgacgtatgattatctcttcacagttttgttctttttttctggagagaaagagatctgatgtccctagtcagccagcttgaaacaatctcctcttgtctcttcttatagagatgctaatctcatttatgaaggctccactctcatgacctaattacattccaagtgccctacttcctattaccattaccttgggaggtaggatttcaagatataaactttggagtactttcatcttaatgtttgcttactcccaaagtgtatacattgaaatcttaaccataccataccagttaggaggcaaggcctttggaaatgattaggtcatgatgccggagccctcatgagtgttattagtgcatttataaaggatgcctgagagagctcccttgccctttcgctatgtgagtttacaaagagaagatgttcatctttaaagaagaggttcttccccacaaacctaatatgcttgagccttgatctcagacttcctggtttccagaactgtgagaaatatatttctgtcatttataagctacttaatttatggtattttgttatagcaggctgaatggactaagacaaagaaggtcactatataataataaaggggtcaattcagcaacagtatgtagcaattatatatgaaccaagtactggagcacccagacatataaagcaaaaattattagagctaaagagagaggcacacccctacatgataatagttggagacttcaacacccccacttttagcattagacaggttatccagacagaaaagcaaaaaaagaaacattggaattaatctgcgctatagaccaaatggacctaacagatatttatagaacatttcatctaactgctgcagaatacacaatctcttccttagcaaatggatcatcctcaaggatagacaatatggtaaactacaaaacaggtctttaaaaattcaaaaaattatatcaagtatcttctctgacaacagtggaataaagctagaaatcaaaaacaagataaactttggaaactacaacacatggaaattaaacattatgttcccaaaggatcagtgagtccatgaaaaaaattagaagaaaattaaagtttctacaaacaaaaatgaaaacacaacatatcaaaacctacaggatacaacaaacacaatactaagaggaaattttatagcaacaagcaatcacatcaaaaaagcagaaaaatgttaaatacacaacctaacaatgcatcttaaagaattagaaaagcaaaaccaaaccaaacccaaaattagtagaagaaaagaaagatcagagcagaaataggtgaaattgaaatgaaaaaaaaaaaaacacgcaaaatatcaacaaaaagaaaagttgctttttaaaaagataaaattgacaaatcttgaattaaactaaaaaagaaaaaagagagaagactcaaataaataaaattagagatgaaaaaggagacactataactgatctggcagaaattcaaaagataattagagactactatgagcaactatatgtcaataaattgggaatacattgataaatgtctggagatatatgactaaccaagattgaactatcaagaaatccaaaaccttaataggccaatagcaagtaatgagatcaaagccataataaaaactctcccagcaaagaaaagcccaggaactgatggttgcactgctgaattttattaaacatttaaacaagacctaataccagtcctactcaaactattcctaaaaatgaaagagttcagaatacttccaagctcattatacaaagtcagtaagtatagtactgataaccacaaccagaaaaagatacgtcaaatagaaaactatagggttatctccctgatgaatattgatgaaaaaatttgcaaaaaaaaacactagcaaacaaaattctacaacacattaaaaagataatttatcatgaccaagtggaatttatcccagagatgcaaggatggttcaacatatgcaaattaatcagcatgatacctcatatcaacagaataaaggacaaaaaacatatgatcatttcaattgatgctgaaatactgaaaaaatacttgataaaatttgacattattttataatttaaaaaagctgcacagagtatagaaagaatgtacctcaatacaataaaaaacacatatgagagactcacaggtagcatcatactgaagagtaaaaaaatgaaaatgaaagcctttcctctaagatcttgaacaggacaaggatgcctatgttcactattgctatttccataatactagaagtcctaattagtgtaatcagacaagagaaaggaataaggggcatataaattgaaaacaaaagagtgaaattatccctgtttgcaaatgaaataatcttataagtgggaaaaacctaaagacttcatacaataaaaccaatgagaactgataaacacattcagttaagttgtagggtacaaaattaatacaatgaaatctgtagcatttctacatgaaaacagcaaacaatctgaaaaagaactcaagaaagtaatcccatttacaatagctacaaataaaacaagacacccagaaataaacttaaccaaacaaatgaaaactataaaaactacaataaaaactataaaacattgacacaagaaatcaaaggagacacaacccaaaaatgaagagatattccacattcatggattgaaagaatcagtattgttaaaatgtccatactacccaaagcaatataagataatgtaattcctatcaaaatataaatgacattcttcacaaaaatataaaaaaaattctaaaatttatatgaaactactgaagacccagaatagccaaagtcatcctgggaaaaaggaaggaaactggagaaatcacattagctgacttcaaattaataccacaaagctattgtaaacaaaatagcagctattgtaaacaaagtggtagacaaaaaaagacatagaccaatggaaccaaatagaagacacagaaagaaatccataaatctcatttttgaataaggcgccaagagcgtacattggggagagaacagtctcttcaaaaaaaggtgcttagagactgattattcatatacagaagaatgaaactagacccctatctcttgccatatatgagaatccaataaaaattgattaaagacttaaatctaagacctcaagctgtaaaaaaaaaactaaaagaaaacttttggaaaactctccaggacatagatcaaggcaaatatattttgagtaatattccataaccataggcaacaaagcaaaaatagacaaatgggaccacattaagttaaaaagctcctgtacagcaaagtaaacataagcaaaatgaagagacaacccacaaaatgggagaaaatatttgctaactatccatctaacaagggattaataaccagaatatataaggagctcaaacaattatataggaaaaaaatctaacaatctgattaaacattggctaaagatctgaatagatatttctcaaaagaagacatacaaatggcaaacaagcttatgaaaaagtgctcaacatcactgatcatcaaagcactgcaaatgaaaattacaaaggtatatcatctcagcccaggtaaaatggctttcatccaaaagacaggcaataacaaatgcagatgaggatgtgaaggaaagggacctcacatacattgttggtgggaatgtaaattagtacagccattacagagaacagtatggaagttcctcagaaaagtgaaaatagatttaccctatgatccagatatcctactgctaggcacataccccaaagaaagaaaatcagtaaatcaaagagatatctgtactcccatgattattgcagcacaattcacaatagccaagattttgaagcaacctaagtgtctttcagcaaacaaatgaataaagaaaaggtggtatgggtactgaaggtcattgtgttaaggaaataagccaggcacagaaagacaaactttgcatgctctcactcatttgtgggagctaaaaattaaaacaattgaactcatggagacagagagtagaatgatggaataagagtttgtggtggagaagtggcaatggttaatgcatacaaaaatatagctagaataaataaaatctagtatttgatagcacaacagagtggccaataacaatttattgtacacttaaaaataactaaaagagtataattggaatgtttataacacaaagaaaggagaaatgcttgaggtgatagacacctcatttaccctgatgtgattattttgcattatatgcctttatcagaatctctcatgtaactcataaatatatacatctactacatacccatataaattaaacaaaaaaattattaaactgtttttatgcctcaaaattattagaatcctatgagattttcatatatatagtcaaattaagtgaataacaaattggtctgagcaagtttagaagtagttacagatgaaaagtccttttcctattgaaatacagcattgagtttaatcagctgataatttgtttataattacatcaagactattaattaaaattaggtaatttcaatatccatgtgtaactataataataaagacacaataatatatgttgatgactatttagttatatgtatttgaataaatattcttatatcatctatcaaggagtatgaatgttgttctagccttgtctcttaatattcaactattcttaaattatatacatatgcaatctttaaaaaattgtaatttggggatatatttaatatgtattatttttatattttctaaaaagctggaagatatttaactcaagctaaaaattaccaaagatcataaatgttctgatttaatttacctggcaaaagaaatattaatgctaaaactttccagggaataattatttcactgcagtacttcattgtaatcactctcatagtttgaagtgccatttaattatttttagatgaaaactatattaaagtgtattttctattggtacaacatataagagaaatatatatgtatatataagattgtctgaattttgtgtttcttacatagttctatgatcagtaaaaagtgataaacaaatcaaaaatgtaaagtaaattatccatagtcaaaaattatcactataaaataacataggttccctcttctgttttacttttatgtttgcaagtcctggtataagcgttagcctatgccccagtctatagatatatcttccactgagcacacatctaccagagctaaatctgttgtataatgtgagcagtcagactttaaaggttgaagccaaaggaaagagcaatgagaccagtcacagaaccagcagactttttaaagaccaattgaaaggccctagactccatggaattctgtgaacatgaagactttcccaaaatgacacacagtcaatttcctgtcatttctaataaaagaaaaactatatcacacatactttaatatagataaacaaataaatattataaataagtaaaagtttgatatttagatggttgtattattattcatcagtattaattttctgattttggtggctgtttgtggttgtgtataagaaagtacttgtctatagaaaatactctctgaattatcttaggataaagagacgttgtgttagcaacttctcgaatggttcaagaataaaaatgttctttgcagtatttttgctagttttatatcaattataaaatcaaagttttacaaaccaaaagaaagctactctctcaagtatttaagatattgcttggtgccccatataatatacatgagtaaattacttgagtgctaatctcatgaaaatatacttgttaaaagaatgtgatttttatatggtgtggagagactttagatgaatgccttcatttattttctctgaaaatggaagaatatttagtcaataatttgctcacatatgaaattatatgttactttgacattcagaatccaaatgtgaagacagtgaatcaggaattctaaaaggaattcttgactatgccttcaaagatgtgtcttcaaggataacttggtagaaagaatatgaatacatactaataaggaaacataactatgaaatgtgaaatgtttggctgataagccagataagttctgcttagacataccaggttgacaggtgctatttttggtataatgaaatggaagaaagagatggagagacattgtttgtagagtttggagaacatcaataagaatttgtttcagtaaaacaatggattttttatcctgctgggtggaggcttccctggattattgttggcatagctaagaccagagaacagttacagactgttatggtaaacaggtattgtggagatgaaagcaggtggtaatggttctcaaagggaaaagacagtgtgaattttcaattcttcaatggcagaaccagaaaatattggatcacaacaggatatcttaagccccagaagtcagaacacagagtctgccagtccagaaacactttatagttgcaggaaaaaaataacaaattcatagtgtaattctacatggtagcctaacattaaaatctaataaaatacatgagtgaattagattaaatttagagaataaaagatttatagatattactaatattcactattaaattaccttacatgtgcatcataatttataatcaagttaattatctacacatgttataaaaactggaactaataacacaatgtacacgattaaatgctttatgtttatattataaaccaaatattaattgtctggctttcttaattctaatacacataaactactcttgtgttatcttgaattatctatgtctatcatatgaaattgaccaaaatgtaaaggtccttacatataggctattccaggtcacctaaatattacattttattattatacaagtattaagtgattggtcatcaattaataacactactatggaagcatgttttttttttttgagacagagtcttactctgttgcccaggctggagtgcagtggcgtgatcttggctcactgcaacctccgcctcccaagtttaagtgattctcctgcctcagcctccccagtagctgggactacagttgtgcgccaccatgccaggttaatttttttgtattttttttagtaaagatgtggtcttaccctgttggccaggctggtcttgaattcctgaccctaagtgatatgcctgccttggactcctatagtgctaggattacaggcatgagccacccctcccagactaggaagcatgaatttaaaaataattttgtatagctggtgagatactcatggaacagattgccacaaaagagcaatgtacaggtagaatttatatgtgtgtatatgtgcacatatatttgcatattcattattttataagcataaggttaatgagcctatttttaatacattacatataatataaacacacaatttaaagaataccttcataaataaaaatatattgaccaaaagaactgaaatgatttatatttctagttttccaaagagaatcactttccatttagaagttaactcactgaaattcatatcagtttgaattttaaatatttagcaccctaaaacatatatatttgaatttgtatgcagggcccaaagcatttctttaactactgtttgggagaaatatatattctagataaactgataattcttgttttaaaaaaagatgttatgtttctctaattagttatttagcctggtgaaatatgaagaaagaggttaagagctttgaatacgattatgtgactaaaatttctatttccttcaagtatttttaaattgtccagtagtttaatgtttcataaaaccaaataatcacataattcgtaagacaggctcattacataattaaagcatgttatttcacaatacaatcatcgaatcacaacttggacctagtttataaaatagtttgtgaaagggtaaaagaagcagtcacaagagacttcaactcaacccttgttatcatcttgcaatagttaataagaagttgaataatactaagtactcttacagataaaatcgagcaaaaataaaaatatcattttctctacttgatatctgtctaatgtaatgttaccacatttttttcaagtgtctagcaaaaattcaaattaagaacagcaaaatagtcctacaatctgatgtctgaaactaactgtgtggctctagaatcttattttgtatttccccatgattgagatttttcactaaaataaacaaattccgcttcttacataataacctgaagaatttgtatcattacaaattgaaagcaactgggattctgttttccacattgagtctctgtaaaattcaaatacaagaatatctgaggaaaatatttagagaacacacatcttatttcagaacttgtaaaatggggctgtaggttaagccctggtaaatgcttccatggaaatcccattagaacatcaaagaagaaagccccatgcctttcctagaggccagtttcctggaaggatatttattcgggaagttaatgttcctcttacttccggttttctaaaagtaataagcatttttttcacaatacaccccttacaaaaattgttctaacttttagttaccagtgtgtggggggaggtataaaacctatatttaataatggaggttattaacttgttagaggctaaaataataaagttgcatttaatgagtagttaaaagattaaaaatattaaatatttttgagaaaaataatgtctgcaagaaagttatgaaagtaatggtaaattctgcaatatgctgaataataatttagtttatttgaaaaatattttactaggaaaaattaatgttatagaaaagatgaactattcatcagttatcaaagaaaagcattaaacttttaaatttttattagttactggggtcttcagtattaaacttaaaaaataccaaaacaagaattatacaatattcatttcagcacagagtagagccttagggaaaaatcctgcaataatagttatatattttcgttgtcatttaacaaaaatgaatagtcttatactcaggcttgctcaagatctaactgagaagagggctaggatcacactcttttagatctcaccctggagctaaatctgtatttaacagcagggtaaaattgttgtggctgtagggagcagcttaaaagtgcacattaaagtcatatagacctccttccataagcggtaggagactagaacgactcaccttcaagaagagatcctcctgttccatgcacttgagggaaaaataatctaccttattctatcaccacattcagctctttgacatgacacacttcagcacatatatcaacaaacacgcaatgtgagaatcagaataaagcatacagagattttgaagaactgtgaaggtcaggattttccacgttatttctatatactgcaggcaaaaaagttctgcactgatttggaagacactgcattttatatccttttcttagaaattcagacattagaatattaaaagttgctaaggcattctaaagacatcattttaactaattaaaatgtactatttcttttttttggactaaagtacttctttatagtagaatatctattagcatcctgcagaactgtgctccatgaaacaatgtctgagatcatcatagatactgtttactttatgacgttatttattttttctactattgtttcataattttcaaatgcaaaagacagttttaaaaataaaatactacaatatttcttgaaataaatccttgcagatcaaatttgtagtaaaattattgaaacataatgaccctcaattatacttcaggtgaatgaaacagttaatgatcctagttgtatgtagataatttaaatagaaatatatttaagtatttaagtagactgtaatatatttaattgtattgaatactgaaaattatcttttgtcaagtaaagtctaaagaaactatctgggatttcattaaagcgaactatggcaagttttgcattctatagagtttgctaataacattttacaccagtttctatagttttcccataccaggagtcttacaatgcacttttaaaaaatgctaatgctatagtagaggtctaaagtgaattaatccttgtgggtaacaatttaagtagattaagcactcagtgatgcataactttcaagagttaaattaccaagggtacaattactaaaacaaaacaacttcatctctaatgacacatataagtgttgaaatgtttattttcctacttctgtgaaaggtaactatcatttaaatatgaggaatagttatgctgtttattatatttgttatgcaggcatatctactcattcaggatttttgtcaattatttttactacacatttcctagggataccagccaacacaaaatgtaattcttaaaattcttgttttactctcatttattacctaacttggtaaggactcctgtaattttgatacaaatccttaccaaaaaacaaacaaacaaaaaacatttattagctgagaaatgtatagtgtactatttatcttaccactaggggtcggtgtgagtgcatgccagaaactgtgggtaaaaccaagattttggtttgctatgttataatttgatattaaaatatgaaaataactttatggcattctccctcattccatttttcacagaaatctattctaatatggctcataagagtataaagaaaatgttccattgtaaattatctctggaaaagctcaggtactaaaatttttatgtattgccagtgtagaataattgtcttaattttccttgtgctaatattaacttcaaaagaaataatggagatggaaaatatcaaaatcagataaccttccctctatataaactcaccctttacaaataatagcagcacttgaaacaaccaaaagcaacacagcttccaaccagagatggtaaagctatgtctcctcaggttctatatgaactctgtagattacctattttttctttttaagagcagcttgtgagacttcacttatctttcatgaaaacttgaagaaaacatgctattctttaaagaattcccataatgccaaaggtatttagaaaaaaattatgaattctaaaccaagggtgcatgaaatatatgtcatatttagaaaggcactttaattaatattgttaatattaatatttagaaggtagttaaaaagagtcctatcacatttgaataaactgcctttttcaccataaaacaaaatggctcaatatggtcttaattgacttgagaagaaaacaaattaatgacaaacagactagaatgcaccaataaaaacttacaccaagaactgttttagaaaacatgcttattgctctgtttgtttctattctctttgtctcatattgtatttcaattttgaaagtaagtttatgtaatataaataagttgatcaattaacaaaatacataatctagactcacatattaaaacaacaaaagacacacacacatcacaagtaagaaactgttaaaaacattctcatatctaatgcagatgttactcatttttaatacatatatctgaacatggattaatataaaactaaaactaaaacaaaaacaaagcattctttgaatgtgagatgctattaataaattaaatcttacagatatatagcacaatgaagatgaactgtggtaccagataaaataccactgaatcaaaatttattttagatttcacagaaaatgtaaaaaatatgaaatactctacagactgaaaatacatatgaggtattatatggtatccattatagtttgggctgtcaatttaaataaaaatatccatcaatatttatttatctgaaatttaacttgaactggggtatcatgtaatttatgtgatgaacctagctactacataatgtgtcacaaattgtaattatgaatagtttgttttttcagttttacctatgtcaaataatggtggtttttttcaagatgccggaaaaagtctttaaaaattaggtagcattctggatattagccctttgtcagatgggtagattttctgtagtttgcctgttcactctgatggtaatttcttttaatgtgcagaagctctttagttgaattagatcccatttgtcaatttcggcttttgttgccattgcttttggtgttttagtcatgaagtccttgcccatgcctatgtcctgaatggttttgctaggttttcttctagtgtttttatggttttaggtctaacatttaagtctttaatccatcttgaattaatttttgtataaggtgtaaagaagggatccagtttcaacaaatttacaagaaaaaatcaaacaaccccatcaaaaagtgggcaaaggatatgaatagacagttctcaaaagaagacatttaagcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggagtgtaaactagttcagccattgtggaagacagtgtggagattcctcaaggatctagaactagaaataccatttgacccagggaacccattgctgggtatatacccaaaagattataaatcatgctactataaagacacatgcacatgtatgtttattgtggcactattcacaatagcaaagacttggaaccaaccaaaatgtccaacaatgatagactggattaagaacatgtggcacatatacaccatggaatactatgcagccataaaaaggatgagttcatgtcccttgtagggacatggatgaagctggaaaccatcattctgagcaaactatcgcaaggacagaaaaccaaacaccgcatgttctcactcataggtgggaattgaacactgagaacacttggacacagggtggggaacatcacacacaggggcctgttgtggggtagggggatgggggagggatagcatttaggaggaatacctaatgtaaatgatgagttaatgggtgcagcacaccaacatggcacatgtacatatatgtaacaaacctgcatgttatgcacatgtaccctagaacttaaagtataataaaaaataaattaaaaaaaattaggtagtattggcaacctggaaataagtaagttttttattacaatttacaataatgttttaagatgaaggcttatacatatgttgccaaactgtatcatacgtcaatgtttttagcattcatagttttatttcatatttcaaacctaatgaaggaatagagattaattttcccttctccttctcagtctctacaaccagcactgtgatcagtgcttacaaataatttcattcagtccttaaagcaacccagtaattgggaattatttcttatatttacagatgagaaaaccaaatatctgataagttaatatacccaaaatgacatgatgaaaacacaccaaaaaacaaactctatatccaaattcttttttttttttttttttatctcactgtgtcacccaggcaagagtgtagtggagtagtcactgctcactgcagcctcaaccaccctggctcaagggatccttcaacctcagtcttccaagtagcgggaccacaagtgtatgccaccacgcctggctaattttgttgttgttgttacttttataattattttttgtagagacgtggtctccttatattgctcaggctgctctcaaactcctgagcttaagtgatcctcccacctcagccttccaaagtgttgggattacaggtgtgagctaccacatctggccactgtggccaaattattcaaatcttccactatattatgatgtcaccttaataatttatttaaacatacttatcttaaatatattaaaaaataaaattaaagtgttaaatatattaattttgaggaaaagtttcaatatccaaatcattttctctcaatttagtggtattttatatttaattttgaaataagttatacaaatttgtatttgggttgttacttggattttctctcattttctctcatattctcaaatacaactaaaatcttccacgctcttgtccttcttttctttctacctcaaaataaacccagctgttgcaagtttagatattgtagaggttttggaagaattgttaactattttacaatttcccagtttttaagattatttaattattatgaatttgcaaaagattaaaatagctttctaggccaagtgctgaaaacatgacctgaagcttcccaataacatttttgacatttggttttactttaacagtgataacaggtaaaaaattgtgctttatttatcatatgtcattgaaattaatatcacaggaagtcatataatatcaaatcttcaaattgtaaataccttgaaggattcatggtacctatatttttatactcgcaaaagtagttatagatttttaagtgattaattgaaaaatcaggagctgtgggtcctattctgattttctttagctagataataggatcatgtacaaatccattgaaataactgaatcataatgaccctatctgaaaatcaatgtgtgttgggccttgatatatttagcaatctccccagttctaaagccatgtgattatttgattggaaacaaaaacaaaaacaaatacaatccttgggtctgattttacaagtcaactatgttcaatgcacatcaaaacatgaaaaaaaattctataatttccattttgcctgaataattctgatgacaggaaaccaccatcccatggggaaaatcagctgttttccaacatctgtgatagttaaaatgtattttcttagacattaactcaattggtctctccaaattccattcatgggtttaggtctgacatctggctttatgcttgttacactcaatcagtataattttcaaccatgatttttcagactgtacaacatgatgttttgatacacatatatatagtgaaatgattaccacgatcaagctaattaacatatttgtcacctaatatagttagcttttgtgtgcgtgttgtaacaatacttaagatctacttttagcaaatttcaagtgtacaatacattgttattaactgctgtcatcctgctgcatattaggtctccagaaattgtttctcttataactgcaagcatatgtcctttgatcaacatctcccgatttcccctaccacccttccctggtaactctcattctattctctatttcaatgagtttgacttttttagatttcacatataaatgagataatgcagtatttgtctttctgtgtctgacttatttcatgtagcataacgtcctccaattaatacaactttttatataagtaaaaatttattcatttggatccttgatttttctaaaacttttaaaaaacaatatagattgtagaactagcaaacttccagtatcagttaaatttacacatgaaaataaaacaaatatttcaactgacagctcacatatcccaactgaatattggaaggtataattgctaatacctgtcacaagaaaatgcacacatctcattacagtttccctaatacctaagctattgggtgatctgatacaaggaataagaaaactatactgttatgcctctttaccaaataaaaaagttgtcaactagtgttttgtaaggatttattatgtgtccagtactctactaagcaaagcacttactaaccaagtataaatcacatgtattttaattataaactaatagatttaattattcttgttttgtttttgctatatcctgtcacggtgcaaaacattacatgcaacttaattcaaataacaacattataaggtgggtgttttctaatcatgcctgatgataaattaaagcttaagaagtaaagtaacctgcctgaaggtacatagctgggatttgggggagctaggaagtgaaagtgggtctttagccttctgacatattcaataacattgaaccattaaactgtaaactcaagctcacgctaagaacaagagatgtcccaacttctgagtggtcagtcctctccagtgggggttttgtattgacaaaatatacaattctataaattaaaggatagaaaactaacagaagacacattcctacagtgcacttacagacagttgtatttctgtattgtaaaacccagagcacacttaagattcacaactaagcacaattaaggttttctggaagaggtaagaagtcaccagatagatagatagatagagagacagatagatagatagatggatagatagataaaacagaatcctgaagagtcacacctgtaatttttcctcagaaaattatcctaagtagaaaatagcagttgttgaactcattgtagttgagagggaaacactctgtactttaaagactgactttcatcattttttatttacagaaaaattgagttcttggtaacaagtgtatttacagcatcctaaatatgatttcagcactcaacactacccttagaagcagacaagataatgaaagaagaaaatgaagtttccaaaaaagaaaagaggcattgcctagtcatgcatgacaaataattttacaaaaaggaagaactggaggtgaaaaaacattgcatgatttttatacattgattatactgatatcatttctgcatattatttaacaaagtcatatatagaatttacagtgcactacataactaatttaaatctcacaaaaaccttctaaggaatactgtattatcaatctcatttccagacgaggaaattaagacacagaaagttgaagtaacttaactctgaagtagtggagggccatatgttattaaatggaagaaccagaatcaacctcaagaagtctggttttggtataggagttaaaaagaaattatttaggtaaatagtgaaggtaaggaagtccttggtaaggttttccttttaatgaaaagcagcccccaaataattttctcttctaaaaaagagtagcctgtgaaatccagctgcacacatagacaagcaagctggaagctttcgtgggtgaatgtcagcagttgtgccaataggaaaaggctacctcagactagacatgttcaaaatggtggctccatcttccctctatttgccaagccacgctttcagtaaggagaagacaatatggagccagccagacaatgaccccatttgcataagattagggtggggtgaccagccttccccgcatgctatgtaaacgtcacacctggtggaaccaatttgcgggctctatgtaaatcagacaccgcctcctcaagtctggctacaaaatctggtataatttgcggtgggctggtttttcactttcggaagcgtctctctctctttctctctctctctttgaaacagagaatacagataacacttttgagttccatgtgttctttcattaaaacttcaatgagagagagagagagagagagagagagagagagagagagctcttatcctttctctttcttttgcctattaaacctctgctcctaaactcactctcttgtgtgttgcgtgtccttaatctatttggcgcaagatgatgaacctcaggtgtttaccccagacagtgatgctgattcagttttagtgtctgtattctttttaaaaatttttactctatttcatttttttgaagagatgttgctcacgctgatcttaaagttctggcctctaggggttctcctttatgttggttttccctatgtagaaaatgtgctacacatagccactctttattgttaattcagtctacttacagcttcttcaaatttcatattcattattgtccaaacacacataagtagaaaaatatatataatgtaaagatatagaaatttgagaagatgcaaagtcaatgctgattggagaaactggacttgactatcataagctgctactactaaaatacaattactaaaagaaaaaaatctgaactaaatgagaaatgtcacaggaaaacaataaagaattataattatataatatgtctcatccttggtgaattattgcagtgtagtaatcatctgataaaatatgttccaatcacaataagcatcaacttttgaaggatatattggaattatcttcattccacattacagcaggtaaaaattagaacattttctattcatattccttggtaagattaattctggataacagaaccatgtcagtaatatccataagagttgtttgattattgtgaaattttctgttcatgaaaaaagttgcttttcagccaataaagtgaagtaacaagcaagagaagaagaagaaaagcaaacttgactgccaaaaaaaagacagatgactattatttttaactttcttattatcagctttcttcattactcatagcagtggatatacacaaatccatttaggggtaaattctaagtgacatataaaacaaacagaagagataatgaatcattttcttcaaatattctatatttcaaaaaaaagtataatcctcaatttacaaactcctaagcagtgttacctatcataatgtcttacaagaggtaaagaacacattcaatacaatttcctaaaaattaacttactatgtgcctagtgaatacttaccaagagcatttatacagaaaatacaatgataaataatcactgtgtctcatgaactgctactatcttagcaagaattatgtgattttattcttgtattttcagatcagaaagttttatgcaaaagtatttaggccacttcctaatcatgtgttttagagtccctaaactacatttctttagctttcaaaaaatttaatataattaaattgaaagctttctttagatgttcaatacatattttaggaacatttaaacattaagcaataagtttattcaaataaattattcctaccgatattttttatttagttagcaccgtactcttgaatccacagtgtcttctctgctgtgtgctgctataaagaaatacttgaacctgggcaatttgtaaagtaaaaaagtgtattagtttatggttgtgcagactgtacaaaacacatggcaccagcatctgcatatgctgagcttcaggctgcttccactcatgttggaaggggaaggggagctactgtgtgcagagatcacatgacaagagaggaagcaagagagggagaggtgttaggctctttttaacagccagctctcatgcgaactaataaagtgagaaatcatgcatccccactactgccttacagagaaggcataaatctattcatgaggggtcaacctccatgacccaaacacctgttgttaagccccacctccaacagtgaggatcaaattttgacatgagttttggaggggaaaatatctaaaccttagcattaaagttctcccttctgtaaaggtagtaggaaatcaagatctggaataagggaagtaggacaaagaaagagtaattcactgcaattcctaaaatagaaattatcttcctcatctatggtgtattgtgtatacttttcctaagaattaaagtctcttcagtccaattgtttactttttttgctaatcatcacttatatgttattcagttccttaatttttatggctcatataatgggattaaaatatttttatgggcttggcatggtgactaatgcctataatcccagcactttgggaggcagaggcgagcggatcacctgaggtcaggagtttgagatcagcctggccaacatctcaaaaccctgtctctactaaaaatagaaaaaatagctgtgcagggtggcacgtacctgtaatcccagctactacaccggaggctgaagtggcagaatcgcttgaactcaggaggtggagtttacagtgatcagtgagctgagattgtgccactgcactccagcctgggtgacagagcaagattccatctcaaaataaaaaaaaaaaacttttttttttttatggccactcctcttatctaataaatattgttcctccacagccatgcaaaatagacaacagcctccagcaaattctcagtctgggctacaaaatctaatgtacattctggatgtgggaataagtgtattttcgactacttaaatttgttgtagtaggaaattttcgtcacctaggtaggcttaacctttactggcatataaattttttaaatactggaaattaaattttagatctagtttgtaaagtatgattatcagagtttagatcatttaaaaatacaatgtgatacaatagtatagatgaattatatatagaaacatatataataaatatattttgcatatatatatttcccttaattttcagtttcttccactgactaccagaaagaacaattttaaaaactaagtgcattttcatcatctttgaagtagatctatatttttcttacaactatttatataattatattgttagatatcaatatgaaaaaataattacatttttaggatataatgttttataaaatgttatatatctattttcatgtattaaatccactgcgatgaaaagtttgttagttgcttttctattcttttaattttattttcaacttccttatatttttgagtatgttttaggactatgatgctcatctttattgtacattgctttttaaaaactatacatcatttaaaagcatacttaaactcatatatttttctgttttttatgttaatagcttgtataattaacctttgttttcagtatgttttttccctttactctgaatttgaggttttctcttttcaagttcttggatatgaactttatattttctctgtttctactctgagtatcttagctgttgactttacattttagttttattgacttctttcagagagcccattagagaggtctcctgttatccacaagggatatattctaagactctcagtagatgcctgaaattatggatagtactgagccctatatatactctgtttttttaatacatacttatgataaaatttaatttataaattaggcagagtgatggaataacagcaataactaatactaaaatagaacaattataaaaagactataacaaatgttatataaatgacccctctctctttctcaaaatatcttgtatactgtactgtactctcctatttggcgactgtaattgactgcagataagtgaaagcaaggataagggagaaattacagttgacacttgagcaatgcaggggttaaggcactgatccctgcagagttgaaaatctatgtataacttttggctcccccaaaatataactattaatagcttattactgaccagaggccttatgtgtaacataaacatttgaataacacatatttttgtgttatatatgttatataatgtagtcttattttaaaaactagagaaaaaaatgttaagaaaataagaaagaagaaatgtatttactattaattaagtgaaactagatcattataaaggtcttcatctatcttatcttcatgttgagtctgctgaggaggaggaagaggaggtgttgttcttgctgtctcaggtgtggcagaggcagaagaggtggaggatgtggaagaggggcaggcgaggcagccacactcagtgtaacttcatagaaatatatggtaatttctctctgatttttctttttttttttttttgcttttccatttctctaaaaatgtttctgtatcatatgaatcctccttctaccatttgtttcagcgccagtgatatcatggtaacatccatgtcataaaaggagtcaaaagcagtgttgaataattggaacacttctgccattgtctaatatcaatttattttctagcattatttcttctatgttttcttcctcctcatctggtgctggttcagaagcactcatctgcatcaagtggtcttctgttagttcctctgttggggtatctgttagctcttgaatttctccaagatccatattttgaaaccctttgcctcaatgcctcacccatgatgttttttgttatatccacaatctctttcatgattttcttgattggttttgttgtaaatcctgtgaagtcatgtataacatctggacagttttctccagcagaaatttgtattgggcctcatggcttttgcagctatttctatagcaatgatggcatcttcaatggtgtaatccttcctgattttcatgatattctctttaatgggatagtcttccatagtgctgtcagttctttccatatagtgccatgtgtaatgaaatttacaggtccttatgactccctaatctagaggctgaattagagatattgtgtttagggacaagtagaccacttgaatgtcttttgggttttaactcatggggttctgggtggccaggggtattgtccaatatcaaaagaactttaaaagacagttgcttactgacaaggtactttcctgacttcaaggacaaagaatcaatgggaccaatcaggttcctgttatttaggttttcttgttttacaagcaaaagactagcagctagtattgatctttagtcttaaaaacttgaggttagcaggtttatagataagggcagtcttgatttaaatacccacacatatacatacatacacacacacacacaaaataaacaaaacaatttcgtttgcataaaacagtagaattagcctataactttctgcccgaaattctgatgttcacttttcttctctagtaataaatatcctttgtagcattttttttttcagaatagggcactttcttatgcattaaaaacccattcatacaaatatctttttttctcagtgattttcttaatgatgtctgggaacttgtctgctgcgtcttgatcggcagaagctgctcctcctgttatcttgacatttctttaagccaaacacctttctaaaattatgaaagcacactttgccagcattactttctcaagctttagatttttcaccttccttttgctttaagttgtcacataatgagtttgcttttttaaaaatcaaatttgagtccatgggtatgcttttcttacagcaatcctgcatccacataaaagatgcattttcattacaagaaaaaagaaggttatttcacaaaaagtacaaggttctgtgtcttttggtgtagctgcagtgatgacttctttactttttaaaaatggtcctaaaatgctggattcatttatcttgaaattgtgggcaattgaagtaggtactactgtacctcaatttacagtactatcaagctattcaattttttcttataatttcatgacttcttttttgtttcaaggaaaaaatccggcatcactagtagcactttgtatgggtcccatggtgttatttaaggtttatgatactgcactaaacatgatgaacaatatgcaagaacttcaggagatcacattttactgtgatatccagtttactggagagatgaactgctcatgcagagatgattagcctcatggggtgttttaagcagatacgcacagcacttgagctcatcccaatagcaacaggaggtggccacaaaattattacagtactatagtatgtactgcagttaattttgtgcagttatgacttaatgctgcatttttatgtttgtttacatttctctctgctgagaatggtgtcaggtatggtctgtaagtgtttgcataagttttgataaattgtaactttttataatagatttgtgcttaatttgtagtagcacatgataaaatagtatctacgtacattttatgcattcatgacatgccaatttttttcttattttttaaaatatttctcatatatgtgattcatctttttacaaattgttgtaaatctccaaaaagttttctaaatacatttattggaaaaaaatcacatattattgggcctgcatatttcaaatccatgttattcaaagatcaactatactgtatttctagggttttaaaaatcacaaaccatgcatttatttactatggcaaatactaatacaacttaagatgctttgtatcatgagtaaatgcccacatttgcttttgtcacaggaacttttttaagcccgatattttacgtttatttaatattacaggaggaggatcctattcatcctgtggttttccatatgcagggtagatgaattctcctctattcatctggctgttttggaaaacttaagtcataagcagcaggtatgtttattgtttaaagctcataacaaaatgtccattgctttatttactaaggctctcctaaacagaagagtgctcttctgttgtgtgtttacctgcatgtgtaacaatacatttaatattggataatgtatggtagttagacattttcttcttgaaaaaaaatcaatccataaaaaagtgattttttcttaaatggatattctgagatgcacataaaaagaggaaatcctatgagccttcaatgactacatggaatgagtaatccaaatcattttatcctgactagctctcttttaggtgcaggattccattttcaatgacaatactcctggaagctaggatattattcatctgtattataagtttttttttttttggttgttacaacttttctgttttaatcagtgtgttgactatttcaatagaaacaaggcacaataaagtttgtaaatccagtgacatgctacagctggtttacaagataggattgaaatattttcaggaatttatcaggctggttaaactctttgtaacttgaaattagccatggttggagtatacacatggatattggaaaatactataaatcagaactattcctggttaatatgactacatatgaagaccaaagcacagtaagggtttctgttgttagacaaaatcaaacaaaagggaaatgtttttgacataaactatagaataagaagatatgaaacaaacataaatatacattgcatataataacaattattattactatttttgagaaggagtctcgctcttgtcgcccaggctggagtgcagtggcgcacgatctcagctcactgcaacttcagcctcctgggttcaagctattctcctgcctcagcctcctgagtagctgggattacaggcactcgccaccacatccagctaatttttatacttctaatagagacggggtttcaccatgttggccaggctggtctcgaactcctgacctcaggtgatccacccacctcggcctcccaaagtgctgggatattacaggcatgagcaaatcttctcaactataataaaatggtccaaaatggaaatactaattctcccaacaaaaaaaggggaacatcctagattcttatcctattattaaatctatttccaatccaggatttatttgtgaattccctaggtcagctatggatatagctcaccatggttaactcctcaacttaactcctcccaagaaatcccataatacaatgatggagaggaaacagaaaattctagtacctttggtgaagggcagaagaataaagcaaatggagtaatctttagtccataatttatgaaagactaatttcttttcaacatagaaagcaagatctttgcctttgcaatggattttaagtcagtttgattgatttaggtttgctctcttgttagatatatttaaagtccacctcttgaaatatatgagtgcatccagaagaattctctttcagaggctgcagcccattagcagtatactttctattggtatacacttaaaggtctggagattaccttagttgttaattaaacccagacctaattaccagtgttgtttcctccaatgacatacatttcaagctgcagtctgctgctggttgattacatggcatcaatggccataagttggatgagatatggaaatgttaacaacaggcttatcaagacacttttattaggtcatacatgaaaatttttacaacatttaagcaataccagatggcctatgaatttttaccacaaatattcatagaaatagataaaatacaattactgtattctctttcctttttttttttttttttttttttttgagatggagcctcgccctgttgcccaggctggagtgcaatggcacgatcttggctcactgcaacctctgcctcctgggttcaagcgattctactgcttcaaactcccaagtagcttgtattgcaggtgcgcaccaccatgcctggctaattttttgtatctttagtagagacggggtttcatcatgttggccaggctggtctcgaactcctgacctcatgatccacccccacccccctcagcctccaaaagtgccgggattacaggcgtgaatcaccacatccggccttacagttactgttttcataatgatgtaaaagaatcaatttgctttctgtttacactcttgctattcaacttatttagtaaactaaatatacttctgttatagactgactatacttccctgccagattcacatattgaggccctaatgtgatggtgcgtttggagatgagacatttggaaggcaattgggtttgaataatgtcatgaggatgaagctcccatgatagaattggtgcccatataaagggatgaaaagcccagtgttcaatccaaacaccaggtgaggacaaagtgagaaaccagccatttctgaacaaggaatcaggccttcatcagacaccaaaattgctgatactctgatcttatgcttctcaacatccagaactgtgagaaatcaatgtttgttggttaggctgcccagtctatggtagtttgttatagctacctggaaggactaagagaacttctgaataaattatccaagatacagaaaggccctaagtatgcatgtgctcattatagcattatttatattcaaataatagtatttaaatagagttacgggttatggatttattacattttctaagcattttcataatgtttgtgtaggaagtagaaaatagactgtaaaatatgcaacaaaaagcagaacacaaatgactaaatatgcaaagttgcagctatgtaaaatatgtgtattgataggaacacagactagaaggacattagctatactgtgaatagtattatggtgtgtgattaggtatgatttttatttgttctaaaatatacttttctgttataatttattttatgatatcaaaatataaactgtaactaatttctaatatgtttcaaattaatataccagtaaacgtaaagcattcctaattggctaggtttccaaataaaaaaaaaaacaataaattttaggtagggagaaatcatggctagtctatagtttcaggcctgaaatagtacttccttcataattgcttgaaaagaacttagtcacgcagtcacacatacaatcaagtactgcctggaaatgttgtgacatgcccaagtataattacattattatgaaagaaaagagaacagattttagaggatagacagcagtcactaccaaaatgatgatccccacgttcaagtacttcatggaaacaacagaatcttgtgccttaagagactaagatgggtagggcaacagtgtatacttatcagtaaccagtaagcaaagactaatgattagtgactgggcacctgttgctttggtgctacctaatactccagaacactcacccaactttatgcccagtgagtgagaatgaattttccatgagctcagaatcataagcttcattcagatttatgctaattaaaatattcactgaatatttgtatttaggaactaagattcataaccacttcgtggagtttatcgaagaatgtgtagtttgccaaagtagtttaaacttcgcaaatttcttaaatttttaagcatttgcttcttaatcccttgcatttctaatttctcaatagggtacaactttatccaataaaacttattaccctaaattaattctaaaatctaattctaaattaacatgaagcatcataagtatgattagaaagattccacattagtttgcaactccattgcttaaatgtctagagaagttttcagccatgagattacagagaaaagggaaatcagtattaaatgttttgctgaaacaaatgaaaaattgctcattttacctccattctactataaaaataattccactctatccaaaacagtgaggggttataaggtcggtgaaaaatctcaaaattattttcattgtctaataaatccaagcctgccttttccttctgcttcctatgttaattttattgtacaagtatgttgaagttactcctatttttgattcattcagtaataaagaaatttaggggaaataattgtttccaaatatacatatatggaataaagaaggcagaaagcaacagattgagctttattctcgaaatttattatgactttttccaaattaacaaaattacataatgtaaagaatgtggaaatttccccaaaatcaaataagcagaagaaaaataagcacttgcaagtcaacttattaagagataaacagtataaacatttaacataattctttcacatattgaaatctatgcataaaggtatatatatattatttgttgtattaattgtagttactattgatttttaatattatagcataaagtttattaatattctaaataacattttaaatgcctgtgtaatattataagacatttctaaaaattacttaatttcttaaagagccaataagatgtagggaataagggctgtatatgttttgtgtccttgctctgccctcttccatgttatatcaggtaagttcattatactttctaaggatacagaaatcacaacaggggtttgtgaagttttaataagatattcaatgtatattggaacagtgtctggtacatcaggagtatttaataaataatagatgttttcattaagaacctatagttacagaatagctgattagccttagtgagaatgtagtcgtttaaaaagccgcattgtattagtgcatgtttaccagaattaagtctcacttaacctgattctaaggtcttcaaactttgcttgcaaccagttctaattccataacaatcagatttacatggattcaaactttcagttgttaggttagtcttctgagagttctagagtaattgtatctactaataaaccctcatttaaatacgattaaaataaaaccaccaaaataacaatgaaaaaaaaaaaccaacaagagggttcctgttccttaaaagcaaagacagcctaactaaaatataattctgacctaaaaagagtttaacaaggatctgatggcattcatttggagaaaatgtactcccttattgccccatgaaccaagaacaaaagaattagaaaagggataaactgtatgaaaaaacaaacaaaatattgttagaaattcagtttctgtaattatgacaatgttgttgcaggcattgacttattttatatttatttacttcttattttttaactagtatatcagtttatatcctctatctcacaaaacagagtttccttttcttatagcaattagactgtaaatataaatgagtttaaaactttgttttgcctaaatttagtaacaaagtcaatgtcaaacatagtctatttctgaaatgactatgaaataaaaacctcttctttataaggagcaacatttgaaattcacatgaagcagtagaataagaaaacagctctgtaggttggtaatatttttcttcattaatatgtgtctgaagacttttcacagaaaagtggtatagattaattaatcatttattaaggcaatctataaatcctcttaaaacaaaaacaattagataatttacatctagtctaatgggaaagtgtacattgaccatacaactttttaaaatgaagatagatttcttttaattagcacaaatgaacaaaataaatttgtcttctgaatttacagcctgagtgaataaggcaagcttattttaagaagaaattcaggctaataattaattggtacttcaattgaaaagttcatttaatttaatcctttactattttatgcttaactcaattgggagtccagagatactatttaaaaaaaaaaaatttaaaaaagttctttttgacgggtgcagtggctcacgcctgtaatcccagcagtttgggaggccaaggcaggcagatcacctgaggtggggagttcaagaccagcctgaccaacattaagaaaccccatctctactaaaaatacaaaattagccaggcgtggtggtgcatgcctgtaatcccagctacttgggaggctgaggcaggagaattgcttgaacctgggaggcagagggtgcagtgagccgagatcatgccattgcactacattgcactacggcctgggcaacaagagtgaaactccatctcaaaaaaaacaataaaaaataaaaaagttctttttcaaattgctgtttcactgttatctgtgtttcacattatgattacgtgctgcattcaataaggtatgcaaataataatacataatagtatattgataatgatagtaaatacacagtaacacatttattttttagtaataaactttttaggaacttttttagatttacagaataatgcaatgagagtactgagatttactgtgttattacacatcctggttttcctactattgatatatttcattggtatatgaaatgaactgaatgtctgtgtccatgcaaaattcacatgttgaaatcctaaggcaaatgtggtgttaggagggtggggcttttgagaggtaaattgatcataagggtggagccctcataaattgcattagtacctttattaaaaagaaaaacaaaaaccagagagttttcttgccctctgtccaccatgtgaagattcgatgagaagataaaggcagtctgcttagtacccataagagggccctcactgagacaggagaattgggaaagcgaagcaggaaaataggaaaaatgaggcaggaagaaagcaaaaggaattaaaagttgaatacagggcagaatgagtaaaaggagagagagaaacaaggtaaaggtgtaggtgagcaagaagcaagataagaggcagaagttaagcagtcaaaacacagagaagtgagtaaggaccccatggctggtgggatccagaccaaaccagtaaggcgcagttcttcaggaacaggcatgtgcattaaagagaaaaagtagccttaacatgatcccatatgacgatcagcatgttaaagctcatgcatatggaatgcatatcaggcacctacttaaaattatgggatagaggcaacaagcaagtgcacagggaccaaattaactaagcaacacacttatcaatcaaaaggtagatagtagctagaaattagccagccttgggaagagaaggaaaacaacacataaaaagacccaaaatataccaaactcatgctgatctcatgtctcatctcacagaggtcagtccactcttcctcttcaagggcgtaatactgtgcttaaaaaacttttgctgccttgctttgttatctgtgtgtgtctcatccatttctttgttcgtgacaccaagaacttggaactgcatggcatcatcctgtaacatcaccagaacccaaccatgctggcacccttatctcaaatttccagtctccaaaactgtgagaaataaatatctgtcatttccaagccactcaatttttggtattttgttacagcagcctgaattgactaaggtggtatggaacacttgttacaattaaggaattattatagataactattgttaaagtccataatttattcatattttcttggtgttttccctaatgtcctttccctgttcctagatcttatgcaagacactatacttagttatcatatctccttgggctcctcttgcttgtgatgtatgttaatttttaagagcttaggtttttacatgcaagttccatgctaaaaaaaaaaaaggaagaattatattctcctttctcatgcaaactaattaaaatacatggaagaaggtagtcatcaaattcccaaactgatattgtaactgagtagcttagcttcaaaatgcattttacaatttttttcttttctctagccttagccttgaaataaactttgaaactctttgttttcctccacttccactggagactccttatactgtgttaacttatctaattatatgcatgcttagaaattccaggggctaatcttgaaattcatcaggtatgaagatctagctgcagaatcctcccccatctagagattaccacaaggcagttaatctaaaaccaggccatttttgagatagcacaagcccacagtcctggtggacaataacccaagatagccatcagagagaggtatgtagatcttgtattatcctgcacctctcccacatactgtcatgccaagttttccctttttaactccctcattcagctcaaactttgaacaagtattttgttttatttatttttatttttatttttttgagatggaatctcactctctgtgtcgcccaggctggagtgcagtggcacgatctcggctcactgcaagctctgcctcccaggttcacaccattctcctgcctcagcctcctgagtagctgggactacaggcacccgccaccacgcccggctaatttctttttgtatttttggtagagacggggtttcaccgtgttagccaggatggtctcgatctcctgacctcatgatcctcctgccttggcctcccaaagtgctgagattacatgagtgaaccaccgtgcctggccaaaaaagtattttaaaggcatgagcctggccatttcccaattgctagcctttgactaataaaactacgttcttttcacagtatcttgctcctcctgttttgactcccagtgatgagcagctagatttgcattcggttacaatatacctatacttccaaaaagtaaggaagaatgattaatatggtaaaagccactagctttctttcacttgccatctctccttccatataatagatcattctgacttttagctaagcacacagctatctaactacggtctggattttccagctcccttgtagctatgtaagacaactatgactaagttaggccaatgtggtatgaaagaaagtaacgtggaagcaactttcagtttagctccttcaaatccacactgtgatgtcttctttgtccatggattaatgaactccctgcactcaataaggataaagacacaaacctaggaaatgaaagagctacaagatggaaagggtctggatttcacaacttcatagaacagattttcccaccatgctctgtactatccatctccaagctattttaaaaggaagaagtaaacttctatgttatttaaacccttgtaattctgggtgtctgtcattgcaatttattatgcaccataactgatagatcccataaaatagatggctagatattcacattttaaatacacaaattaaaaagactacatttaaaaatattaatgagcatattggcaataatgaaatagttaatgttaagttatatcaacagcagtcattttataatgcttggttgaagagctttgaaaaataaattaatttttatgtagaacctcatatctaaatttctgtaggtgataaattctatacttgaaccatttgttttcctcctgttaattataaatgaataaaacacaaatttattatgaaatgaatttcaaaactgccttgcttttttcagtgaatttgaaagtggctgcgtctaaaccattatttgccttaaagtaaaagacatttttaaaaaatcttaatgcaagagaccttagaagaaaaggcctttgacactggtagcatctatgcagctttctgtaacagcagtcttctgttacttcattaaatgtttaattttcacaatatgctagtgaaagcattcagcgttggaacaacaagaataaaaatagaaggatatttttgtgcatactatttggtggactgtattgtgactgtgtcttagagctgaaaccacttgaacattccttgtcattttgatcttggcactgtccctgaggctacttaattggttgtataaccaaggtgtcagctaagaggttcctgctccttggagaactagttaaaatgggctggaaagtccaatttttatagtctgtataaagccttcctgacaacctgcttgtttctggggactttataacattgagcttaatctgctgctacagtttcatcttccatctgccatgtcactataacaggaattttagctccttttctagatttcaaaataaatccaattgcattttgttagttttatcacattgttaaaagggttgtgagaattaaaagaaatcttgtattggactgaatagcctaaacacagtagctccatctttcttttcactttgagaatatatagtaatttagctatcactagctcaaatatccaatttacattcccaaatgcatcaagattctcagaaagaacaatagtcctacaggtatctacaccccttagaaagtagctagagtcagatataataccccgacctttaccctatttaaataaatttgaggacactgtaatcttaagggatttgttggtcaggaccagtgactttaatgcaagaatggacattatgataggataggtaagtggagtagctaaaagattgtttatgagccaatcttagaaccaggtgaataagacgtgcaggtaaataactaatggcttatatattactgtttgatttaacaaaaaatctttcaaccattctgaattcagtaactaaaatctattaagattatttacaataaccaggcatgctattttctttctttgtttatttgactcagctatacataaatgtcattttgaatatcaaaatgtttaaatattagtaatttcatatagttcaatataataggtaagcaaaatttttctcttctcctctctcaatttattcttatgcttttactaacctgtaggtatgccacgaagattcattgcccaagattcagggaaaagttggagatatatgcatcaagtgagggtaaaattcaagatgataaggcacaaaaattggcttaggataaagaaatatggtgcaggcaatatagatgcttgccgtgattctgctacttaggaaatcttatgtaataagtgctctggcaagcttccacaatagaatcatggaaaagggtaatgaagttcaggacatgctaccccaaaatatgacacgtgggcatttgaagaaacagcagaagcaggaaggtcattctctgaccttctccatcccttgtcctctgaagtagactatgaaagaattaactggctttcctctgaagtggaccataaggtcctcattccagaagtactttccacataatgagagaaaagaatgccctaatctctgaagacacatggaacagaaagaatagtctaaactaacaggccttgctaaatgccaccttcccaccagcttattaccattaggtgacacttttgttgtcttctaataatccttcttcacaactatcaaattcttcatcaaacttagcataaaaatacacagttttccctgttttgggggtcttcagttctgaaggttcttgggtcatgtaaaacttacactaaatacatttgttatgcttttctcttgttaatcgatcttttgtcacaggtgtcttagccaagaacctagcgatgggtgaagaaaagaaatcttcactcccctacaagggaaataaaggctgttctttttaaatatgaaatcataattgttcctgtggtgaatctgcagagtaaccagccttctgctgtattcattagaacctggctctaagtcatgcaaatcattaacattatccagagtgtttttaaacaggcaaaaagctatcagcctcttttgtcaacagaaataccaaatattatgcttcataggccaaaggaaaacaagagttcttgcaaacatagacaagatactgtgggcttgaggtattacttcctaggcatcaaagaaagtcctttcattttctagggaatgtaaaaagtccatccaattgctttctgacagtgtccccatttgaaccgtgatgcccagagagaaacaaaacagcctgtcccactatttagactcaatattcagtctggaacaaacctcagaacctgacaccagaaaagacatccagggaaataaaggaggtcatttgtacaggctctgtgaggcaagaaaatctaaaattcagagaaaaacaaactagaacttatgagaaatcaacagaagaagtcaagaaacaccattacaaggtaccataagttgctctacagaggtcaattttggtttttattttttctctcatttgggaggatgaatattcagcttaaattagatctaagcggaaagagaaaatcaccatggaatatatctgtgctgtgggtctcattactgaaaaagatgccctgaaaagtctccttcagttatgcaaacggaggccttgtggagtccatttgcttgagagaaagctataagaagaagtttgatgtctaagtggcttgccctaaaagaatatgatggataggaaaacaagtgaagattataaccttctggaaaagaaggatctgacaccccagctgccatttctgagattagaagttgaggaacactctcatatagacaaatattatcttaaccaagacagggagctcagtaaaaccagactgagaaaggccatagggctgtttcagggatgaaattcaaaatacaaaaaggttaaataaaaaatctgggtcctctaggtagacactgttgaatctgtgccagttctccttatcttactttataatctgtcaggcgaatgtaagttgacaaagctggcttctagctgttgcatcatgagggcgtaccatttttggtgcattgagtacttactctccaggaagactggactatgacattcaacttcccttacaatgactttcaactttgactgtatattaaaattttctgaggggactttgaaaaaatcccagtgcccaaactgtcttagaatttgtgcatgtgggactcagtaatctgtgtttctaaaagcacccaagtgatttcaatgcaagaagaggttgaaaaccaccattttacaatagtcctactcagtatttgaagtgctaactagccaccaaagggtcttgtaaaaatgcagattctgattcaataggttaagggtgaagcccagaattttacattattaattggttcccagatgatacctaagtagcaaagtctgaaagaatctgttgtgaacttcacctcttcagcacctgtgagaggagctggttcagtggacttagactctgatgctatgtttccataccagccttcaggtgacgacacttataattgacttacgaagagatttcaaaacttgactatcaacctactgtggtatagtaagttttcgtttgccaccacatagtgaatcccttactgatgtcttgcggttgcttgaggaccatgctccctctgttcaatgggcagccagttctctcatgggccctgcacctggcacgtctcctggtttaccatcacatcctttgcttcaccagctgcctctgtaggtagaaattgcatgtcctttgatgcatgtttcattgtcccaccaggcttcacttaaaaacaagacagaagtctcaataattttaaaatgacgatggcagatcattataccaaatacaggtcccttctcagtatacgaccatgtgagattgcataggtcacacacccaggaagctgaccctattcttcagtcttcagtggcaatgtttctaacctgaccttcgactttttcctagttttattttaaaactagcttaagaatctttcctcctacattttgctggactgacacacagaaaggcctaattctgataaactatttctactaattatactactaattctgagatctacattttttgcactactgagacgaggaagttagtccttatcattcatacaaaaaaaaaaggtaagcaaacctaattaattgcacctggaaaaggcagggtattgcatattccatattgcatctgctgactcttgctgttttccattttgaacttcttcctcttcctctgaccctagcaagtttctgccctctgacaggaattgagtttacagatcttatttgacaacacatatgtcaaagaacgatgtattgcccaaatggcctgtaactatgttcctctcaggagggaagtaatattgggaaaatacattcatatttcacttgaaaataaatgaaagcttaggttatgaacttaagcaggaagcaagacatcaaagagaaagtttgtaactggtaacaggtgacaaaagataggagagacttagtatatatgtgtgtggctttgttagctaagatgaagaatttggattatttttaaaatatgcaagaaagccactgtgaagactacagtaacataacttgtcttaaatgtttttttttttaattgctctgactgttttcaagaagagtgagtggaaagagactgtcaagaagagaaccagagagaacatttaaggcaaaaatatcaatattcagataaaagatggtggcttaactgaaattgacaacagaggaaacagggacaagagattccactccagttgtggaggtgaattaaacaaaatttaaatgaataaaatatgaactaaggaaaaaaactggatttcttgtgtatatttatgggtggatgatgagctattttctgacatcaggaagagggaagaaagatgagacctggtgtgaaggaagacagaaggaagaatatgatttatttgataagtaaataaacctattgcattaccacatggtaataccatgtaggcagttgcatatttcagtttggaattccaggagatgagaagaccaggaagagtcccaattccttgggactagacgtagtgatctagagggagtatatgaataaaaaaaatagaagccccaggactgagatctggatcattccaattttggagaataaatagaagagatcccggaaatgtaattaagaaagagtgaacattgacatatgaggaaattcaaagatgtggcatcacaactaccaagagaaagatgtgtttttagggaaacagggaaacatgatgagattaaatatataaataaataaaataataatctcatgtcccttgatgcattatctcacctcaagtatctgctccctcattcttgtgcagtgctctttggtctccccagttgtgactgaagtgggctcagatacagcttgggatatacttgccagaaagcagaattagtaaatcttcatggcgtttgcatactgccaactctgtaggtgcatagagtacaaaagctgtggaggcatggctttttccatctactttgcaaatagtgtctcatggagcctcaagtgtgaggcaaagaaccatcacagtggtggggctgccctttccaatgtttaatagagctgtggatgcagtgctgcccttgagaacccaaaactgtagaactacaagactgcaacagcagcctgggagagctgcaggcactcaactccaacccatgagagctgctgtgtaggctgcaccgaactcatggggatgcggtgctttagagccttagggttggaaacccttctccagttgttcagaggcaggagtacatggagtcaaagtttattttcaaaccttaagatttaatgttgtttaccttgttgggttttagacttgggatctcttaccctttgtttttctgaatttctctcctttgaaatgggaatgtctatcccataatattttagaagtgtattacttgtttggtttcacaggctcagagctgggggggggcaatttgccttaggatgacttttgccttgagttccaccgatatctgctttagaagaaactgtagatttagactttgaagttgatgccagaatgagttaagacttttagggctattgggatggaatgaatgtattttgtatataagaaggatattaattttgagggcccatgggaagaccatcatggtttgaatatatgtgtctctctaaaatttataagttggaatttaaaccccaatgtgatagtattaagaggtggggacttcaggaaacaattcattcataagggtggagcactcatgagtgggattattgccttataaaaggactggagaaagccaactagatccttctgcccttttacccttctgtccttttgtctttctgtctttctgttccttctgccatataaggacacaactttcatcccctccagaggacccagcaacaaggcatcaccctggaagcagagagccagccttcagcagacagtaaatcttccagtgctttgatctcaaacttcccaggctcagagctgtgagaaataaatggctgctgtctatgaattgcccagtccaaggtattttgttatagcagcagaaacagactaagagagattctcatgactttcattttctcagtgaagtgtaaggcaaggtcatcactggaggaataggaaaaagaaggagttatgaaaaattaagggaaaggataatctttcccttcttaatttgtcattttagagaatgttaaagcatattacaaggatgtattaagtattagactctgtttagtgtccattttttatttatgtcattaattttaagtgagactggccaatatggtcatgggattttctttccaaatctgttctgctaaaacactcaggtatttggtttaactaggtaaaagactttccagaagtatgttgtgaaagataagtgtaaggaagtttagacattttcaaagcagaagttagttataactacgggctagaaactttaagttgtgtaaggataggagagaagtgtgggcaagatggggatttttgacagtaataaaataattgagtaaatgagtttgagttatctgtgtggtcaaagacttgctaagtttaaatatatataaaagcatagaattgagagtttgaagggcacaatataagattaggcatgtaagatagaaatgagaaaaaaatggctatttgagtgataagatcagtttatggatttatcatcgactggaatgctgaaatcacaaaagtcaatgatagaaaacatagttggaaataaaagagagatgttgtgtgttaaaattatccatgaacaagtgaaacctcagaagcttggccagtggtaacaataaaaatattggtagctgaacaaatcttataaaatgtaaatctaaactaagcttttgggacaaaaataggtgacaaatacaaatatgtatgccattaaagatgcagatacattaacagagtaactcaaattccagaaaattaccctaaagcaatacacagaaaggaacataaagatttatgtatattcatgctcaatgcaacattacttaaggtaaaaatttagaaacttaaatgttcatcaaaagtgaaataaaataatttattccattgaaaatcacatttcctagattattcaatacagagagaaaatgcttatggcatggaacatggaaaaaggtaggatatctatctctataaacaaataagtttcaattttataagatatatttaattttaaagataaatatgaaaccatcctacatttggttagtaaaattaattttcctgtcttatattctgtgttatctaaattatgaaaaaacatgaatattatagtaatttttaaaataaagttttaaaattatggagtacaaactaataaaataataatttacatacattcatttctctcaacatttcattttttaaagatactatccacttttctggatttaaatttaagaatcagccttctctaatataaaaacaaaatttttttaatgatacagtgataaaaatagttttaattaaaattcaaatctgattttatgaaaagggtttcatcaccatctgagcacagtgttgtaaatatatttgaccacattttctattatgtaatgataagaagggacactactcatggatgatttttaacccttctgccttagaaactgaggcaaagctgaatagtaaacattttattttgaagagtgggattctgagagaatgattgtgagatgggaagctaagcagacatgaaggagagccagtcaaaggtgcattatttaattggtcaacaataggaatgacttatataactcaaatcccatagaaacacatatggaactatatgaagtgtgtctcagaacttcctctctgggaaaattgaggaggaatggttacccatgggctcctgctctccatttgtcagtttcatccacgatattatttacatttctgaacctccaggcttgtacctagataagacatccccaaacatggatttccctttggcatcaacagagaagccctgaggcaagaagaaagagacatggggcctgaagcaggctggagtctgcagaactggtaaccatagcagtgtctggggtgagactgatgtaacacgtatacacatatacttcctaggtaaattgggctgcaaggagcttttctttaacccctgaagacactaatacaaatcatacctggggactagtatcagctatcatttccaaaaataattccaaatatgccaatcatagacaaccatttagaaacacacattttattaaaaggctatatatatttaaatagatgctttatattctgtcattttcttccaagagcagttttaataaaggcacagaattacatagtgtatctcctggtcatagattactagatattctagagctctctgaggtagggttgatatgtcagctatttgctggttatatatggataaaattctaatgatccataaagtaaacagccattcaagatgatttcgaatgatgtaaacatgcacacacacacttcttgtattagagctttttaaaaactttaatagaataatttaatagaatagagctaaacccacagcatatattgacagctataaatggaaattttgacactgatcatttcttctttcaactttgatcctctccctattttgcctgaaattttaaactatagacacaggttcttttcacaagaccattactttattctctgtcagtgtttctctatcacatttaaggtgaaaatgtattaaatataactaaatggctggaccttgaataatactagaatttctaggcaatatattgataaaaatattctgtatattttacctgccttgaaatgcctaatgcctaacccaataaattgttgatcaaattttatgtacccttggatagaaaatatttcaatggcaccaactgacaggtgtaaaaactaagatctagagaggttgtgtcatcaaagatcatatgacacaatagaggtagagttccaaaaataagtcagatatcctcattacaaattctttccatcaggactctaggactttaggtgacacaaaagccatttaaaatgctctctataaaaaaagacctattggctcttaacaacttaaaggccctaaaagtgatactgatgggactaaatttaggcatatctagaaccagccattaaatattatcagtcaatttctcagcagaaaacacacgaaacaatcaaaattaggatactttttgaatttttttttaattgtgtgtgtgtgtgtgtgtgtgtgtgtgtgtaagtttaacaaaaatctgtgttaggcaaggcatggagaaatcccaagaatttattcagtggtacccaagtaccattactgcatctgaagttattgaaagtagtagttacagaatcacaaaacagataggaatgtgtaaagggtttaggcattaactttagggacacactccatcccagggtgacgtctccttctctggagaggcattcaattaaaaatacctaacctgatttacctcccttctctaatgacctgtaaagtcttctcattttacaagtggaagtcagagggtaagggatcccattggtataacccataaaggtcagcctcctaagggaggtgaagaagattacagaatgtatccggagaaacaaacagaagatatctagtgttgaccagtagtagtcttgtctattggatgaaaaatctatatccattacgagagaaaaaaagcaaaatctcatcagctaccaggtcttcatggtaccaatgtcaccatatcctagtcctatccctgaaaactaaaacagcatcagtttttttgttttgtttgtattttccatatagagtagcaagaggcaaggggttgaatagcagtccccatattaatgaagcatagctgctataatccttgctttctgcagcaggttggcatagcttggtaggcatagcttctttctttcgccatccatttcatgatcttatcctgggtcagaatattggctaaacggtgttctttaccctaatcagctgacccaagtctcaatgcatatgatttgtgtggggttctgtcttcattaagttgcaatgtatttccattgaccaagatttttgagtaaggggatactcacaggtccccctgggatctaaatatagtcatcatttcccccatatggcaaaactcagccttttcctctccctttcctgctgcaactctggactgaccttcatgctggttccatgtatcttgacttcctcttattcctgctctgcttcttctctcacaccattgctcttcccttttgttatcccaccctttcctaagcacatctttctcactggacaatactccctcataagttttataaagtaggtggggatgatgaataacccatagtcggaatatttataaaccttgtccaaaatctgattcttcataactatccctgtgaactttcctttaagatttattggcaatgaatccaactgtctaaacaatccatctctgatttctgagattgcttaactagcacattccaaatatactttggtctcaataggggtgaaaataccacagctgtgcaatcttcttttttggtgaatggtcttaaatgtgacttgacaggtttagttagaaaatagaagataggattgcagacagttgactctgaattacaagaccttgctgagaaaatagaagatactttgactcaaaaaaacaaaaaaaagaaaaattgtagaccaaattaataacttcttagattgaacaaatagataaactcaaaacaaaggataatatttctagacatagatatcagttgatatttgatataaaaggaatactaggagaaaattatcctgtctcagaaagatataatctaaaacacaaaggacaaactttgtacaacatgacatccctctaagtatatctatccagtgtagttttcctacaattgccttaaatacaaaaaggagacatttttctggatttgcaaaaaaaaaaaatgttttatttctagttgataaaaaggccatactctctaccagaaaccctaatattgttccacattcctctttccttcaggtgtccccccaccccacacacaaaaactagtagaacatacttcaaatatcactctgacaatgcttttgtcttagctactttctgactctgcaactaactgacaatctcactactcatgtgcttttctgctcgattatcctattccagtgaatcaattgacacaagatctactttgtaacttggatgccaccattaaatatgccagaacttcccctttctggaattgcagaagagaatctctggccaattatttaatcatggctcagattaaccactacttgatgctttatcattttataccttaaatatttttcctattgcctccaagccaaatatgtttcagatgtggaacacttactggaggctgaaccaactggtttatttatgcccttattgtagtcattcaaaagccaaaggaaagagaggctcttaaagactttggactatcatatccacatatctatagaatggactcataatcttcgactgaccaagtaatacccctgctctacccatcaaatagacaaatttttgctgttattattttgtacataatgtaggacccattgaaaagactattctttctcatttctctgcagtcctttaccctaatataatcctatgttcgatcccaaagatagctgctgaatttacagtgtagatatgtatgctctggattctcttgcatgcagattaaattatctatttgtaatcaattgagaaaatcaattagacagttatgattatcagattttgcagcaatatttcttgcaatcatttacgtataaccttggagacattccattttttaggaccctaatcttacatatgtggctgttgtttcattatactttccacactgagaatctgtggacatgcttctatttgcttacagtaataagaaacaaaaaaggcaaaatctttaaagataaacttcacttttgtcagtcccaagtggttttcaagattgtgaaatctataaaaagcaaagtctctttctcctcagactggagtatattcaagactttccccaggcaataatctaaagacagcttagatttagagagtgtagatactggattcctaactgcttccaactggaagccactttttatgatctaacgctgtcataccttgcccttgaaagatgcactaagattttcttttgaagctcaaagctattcctctcaaccctcactcccaccttatatactcagacttccttactaccatccttttttttctatttgcatattaaagattgggaaaatgagaatatgaggattctaactcaacagtacaatggccattacagactcaatgcttatgggtcttactctcttacttgatctataataaaagcctgtttgttttctagtagtgaaaatagccataattaacagcagagttaactgagacctatatgtacttaattcttaggctccctacttaacctcatgctctctcatgtagcttagactttaatttagaataaaatcatctaccatttttatgtatctaaaatgatcccctaggaagcacttctctttttgctcacacatatttctatcaattgttaccgcaccttaacctgttatttttcttcctttggtaaaggagggcaaatctcctgactgtcatacacttattcagaaattttccttgcctcactctgccctcccttaaactctgtgttctccatccaatattaaatgctatgggtagccattcacttgacaaacaatttagattcaattataatacaaaggtaaaattgatgagagctgtgaaggcagtcatcaatagagatctgagacttcaaccaacactttcaagaattttgaagtatttgaggcttaacgctacttgcaagcatcaagttagcctgccagagtttcatggataattgcagtaaatacagaactcctgggtcaggaagaaaggacagaaaggattatccacatcagtagccatgatctgtacatcaatatatttgtgttagttcccgttgcctgatgtcccatgggattaagacagatagaatcagatggttgcttgcacaattaatagttcctttataggataggatctctgaatttagggaatcttaatcttttgtcagtggacagtaagcattcttgctctctgctacagaagaagacactccttcttccagtatttgctatacaaaagtcattgaaaagagtgtctagaataaatgtattaaatgtcccacttgtaagatttgcagagaagcaagagaaactcatgagcaattgtctcctaacaaacacgagaggtgtatgtttagagatttaaactaaaattaggtcacaaaagagtctttcccaatgccagagaagaactgtgaaaggcagtaaagggctgagaactttctatggcaatttctgtaggtccttgtcattgaagttcttcctctcaaactcttgtgtatgactttaaaacctaagtttcctctcatctctcttaataaaatgcaaattaacaaagcttcgaaatctacatagtcaattcttctctcttatgacaatagttcttacccaactttttgcaaaatgaactgaactttgggtatcttttcctgctaaaaccccagataattaacctcctttccaaagttaggatagtctttctgtacctgtcagttttaaagaaagacttatgctaatggtactctggttgattttattaaacactaattttatttatttacttgataaatacttattcgttgatttaccagatatttatttgcccaacttggttccaggcattgaaaatacaaaaatggataaaacatcaaattttttattcctaaagtttatttatatatcagttgaggagatagataatattcaaacaaatgtgcaatgctatataatatacaataaatgtgaggtacattcctggctatatattgaaattacctggttaatttagaaaattccacctgttcagtcactttggtaaatatattgattcagcattttaagggttggctctaaaacaatttgccatctttttcagctgctcaggagattctcatacagatgaaggttgagaacaatagaaataagtggtatgaaggcaagccaagcagtatagtggaagtaaatattgattggagtggatgtagatgagggaaggagtgttgccctagggaaggtaaacattaattggagtggatgtagatagaaggagtgttgctttaggtaagtggtcaagggaagtctgaaatttgaggagactctgaaaggatgtgaaggagctagtcatgcttgtatctggggaggaagagtcaaggcctaaagaatagctaatacaaaagctgcaacacaaagtttgctaggaatatttgagaaaggaaaaggaggttacaaaagaacatgtggctggatctgaatgagactggtagaaaataagaaagtaagtcaggtgaaatactatcacttagtagtttagaacacagcttctggagttggactaccaggggtcaaagctcagctttgttattttttagtaacataatgctgggctaattatttaaccttcttgtaagtcaatgtctactcataggtaaggtggaaataattaaagtaacaaaccctttgtttgttacttactttaaacctatggcttaacatgtataaacacacatacacgtgtgtgtgtgtgtgtgtgtgtgtgtgtgtgtgtgtgtgtgtgtgtatatacattaagccataactaggcacttctaaggaggaaaaataaaattagccttttcatagataacattgtactaattgatagccccttctgcatagttcacattaatcaaaaagttcaaaatttgacttattcttggtggaaaacaggaggaattattataaaaaatgttatcttacttctaagtaaatattttatatggatcagtgtgaatgaattcagctctaaaaagaaaatttatattgattctatttcaagtacagttgtgagaatgttaatttacaacacaacatcctcctttcttgacttaaaaaaaaatgcccgaagttcatagttcacattacagttcagtctcagtatttgtacattctactggtttagaaaaatgtattatggcatgtatccaccattactgtgtcatacagaatagtttcactgccccacaaatccttggtcctccatcctttcatccctctttccccactacccctcaaaacaaatgaccttttcactgtctccatagtctccatagttgcaggcatgctgtctgcaatgaggcaggcagcttccactgtgggcactgggaaataaagtggtgcccagaagcttggagatgccaggaactgcagagccccaaagagggtgtcaaagccctggctcagggagctccttggtctgggttccctgaagggccacagctcttctctccttcttgtcacccacaacgtggtgagtggcggtggaggtatgtttcagccctgtttgtgttacagctctttcagtcctgctgtatggcaggtcctgagtttttgtctcatgtccaggaataatgaggtatacagacaactggagcatgagcaaggtgaagagatgctttattgagtgtcattacagctcttaagagacccaaagtgggtagctcctttctgcaggcaggttgtgctggtgtctatgcagctctcagtggagaggagaccaggagtgggtagctcctctctgcaggcaggtcattccatcatctgcctgagcatggttgactttgtggtttttatgggcttcaaaggggagaaagtacatgctgattggtctataggcagccatggttgggcccagaaaaagcaccatgaattctcactttgatctgcagaactgacagcctggtccctaggcttcaggctatccctggcttgaaggtggggcttcaatagggacctacccctttccccccaggagcctgtctgcatcctgccaccataaacccattgtccacagcacccacagtccccaagctgttcatgtggatgggtgcctgcagctgtacccagaagggcaaggctcacacttcttcaacttggaagggggaatgagttcagccagctccatggagtgtgtagccccagccgtgcctcccctgatgcagcctgtgtcttcacaacagctgttccagatggcccaccactgccatcacaattgcttgatcatatggctaacttcttatacttatttgtttgcaaaacactcacaaaaggctctgttttattgcataattgcaaaacagaattattgcactgaaagtttacaaaaattggggaaaaagagcgttatatcctttggtggctataaacaagaaaagtattcatcagaataaatctaattctccttttgtaaaatagtaattcctaccattgcctaatgtaagagagtagtagcatttggggttttaaaagaaataaaaagcacgtgcttcccactgattaatgtgagatagcactaaagtaagttcctgcaaactatttatatgttcctagatgtctgaagcattagtgtatacaacttcatacttacaaatttataccccaatttgaaagataattaaatgttcgttttcactcaaaatgtaaaagaatttaaaaaaagcagaaacatggaaatacaaatccaagtattttatgtagtttaatacatttatatataaaaatacatccattcaaataattcctatactgaagtacatagagtattgtactttactcataaatattgttctgaaacattgtagttatcctcattttactctacatattttggttaagactgtgagcatttacctaacagaataaggtttggagagttaacactgtctggcgagaaatttaaggacgctttaaacttataaataagttcttcctaatttagttgtttcattggttacttggttttaagccaagtgttgacaagtaaagcatggaaacatttctggtgaaaaaataaactgtaaaatcttttgccactcttaggagatattttagcacatgagaaatgtgtggactttgaagactgatagatctcgatttgattgatgcttgatcattcactggctctgtgaacttgaaaaaggaactgaagctattagaatttaagtttaatcatcaataacagttattaaaaatattaaatgaagtaatatatagaaaagctggctctgatcaaggtcactattggtgtcaaggtcattgattactttcatgttgctaaatccaatgagaagttcccagtcctcatcttatttaaactattagtgacttttgacatagccaaacactctttcctctgagaaatcattccttaaattctaagacaccatactctaaacgttttccttcaatctaactggccactccttcccagccttcttttctggtattgtatcttcctgataaataatttcccagggttactcttcctttttttattctccatctgatttacaacccattcatctcagagctttaaaaaccatgtctgtggctgatgaacctctattgtacatctctagccctgacctctttcctgatttctggattcttatgccccacctcctttcacacaagtttaataggtgtctagtagatagctaacaatcaatattgtcaaaatataaattatggatcttctttccccaaatatgctccatctgatgccctatctattttggtttttggcaacttcagtattgccattgtccaagctaaattgtagagtcatttttagttttagttttttcagaaaccacatctaacacataaagaaatcctgttagagaccattggctctatcttcaaaatgatctggaaccttatcacttccgagcacctccagtgctgacctcctatccaaccggcatcattactcactaacattaatcttttatcctgttcccctatttctgctctgatctcctttagtatattataaacatggcaattaaaataatcctttaaaaatttaatataaatcatgtcattcctccactatatatcctgcaaaatatattcattttcttaagaataaaagccaaattcaatttaatggcctgtaagtccccacataatactttctctcatttcttctcatcttttctccactgctctgcctgacatttacagtcctccagctatagggggagccttgctattcatccaagtcaacaattcatttttcaaccttgaaacctttggactgatttgtccttcttcctggaaattctttctctagttgcctgcacagctaattatctctgctacttaaaatatttgcccaagtattattttctcagtaagacaaattagtgaccttcactcctcttctacccacttcagatcccacatagcctcatagtataatattgactccttattatacattatcttttcaaaggaaaatatatactgtactggtgatatctgttatggctatagaagagagatatgtgttgtcaccagttccgtgtattttgcctgtttattttcatcatcatgcagcttgtaccttgtgatgtcctactccataattaggattagtagaattttgcaaatacaattttatcttctggtttttgttgtcttttgttttctgattggaaatctaattaaaaggtagcattaggtaggttatcatttgatatcatatttacgttttgtgagaactttaaaactgttgggtgggacttaatctcaacagttcatgtgagttttccatgatcagctcagcagcgattgagtgtttatgtctgtgatcaattttaattttagactaatccttcttaaagtataacttttgttgacaaggccacagataggatttctccaggtatgattcttgaaacaaaaatttagaatcttcagtaagatagatttggtgtgtttactagccccttcagaaaacttaataaaaatgagcttcaacataacattacttaaagaacaagatcttagttttaaacaacagttgtttatgtgatcactcctatataagcgccatcaggaaatttggccttttgttatttttgataatttgaaaagacaatcatcatattaaacaaccattgagtttctttttttgcagcttcctaatttaaatttcataatagattaatatgaattgtgtaatttgagtctatcatcttaaagaactcaactagtatcataataagaattataaataatatgatcagagggataacaacggatctgactctatttctggtgtttatctgctaacttttatcaagccccaccactccatcttcgcctctgccttacatctaagtaagcagataagaaagtcagggcctccattttttggacctcatgctaatttcaaaccatgaaagccccaacacacatacagacaagaatcctgtccccagctccactccctaaacacaataaaaacgaagctagtttcctttctctgctgtctcaagccattttcagacctgtttgggagccttccctggtctccccagaaacattataaggcaagttataaagctttttcttttctttcttttttttttttttttttttttttttgagacagagtcttgctctgttgctcaggctggagtgcagtggcactatcatggctcattgcaacctccacctcccaggttcaagcaattctcccacttcagcctcccgagtagctggggttacaggcacacaccaccctgcctggctaattttttgtatttttagtagaaatggggtctcaccatgttggccaggctggtcttgaactcctgacctaagatgatccgcccacctcagcctcccaaagtgctgggattacaggcgtgagccactgtgcccggcataaagctttttcataccttcttgttgaatttgtatatagcatcttgaatctgaatcaaattacgtgtgggttgggtgcaggaacagattcatccttttttcatagtgtgaccacacaaaagcaaaatacataataatgaagtacaacaagtggtctaaatgaatttcatatctgggcttatacatttgtaacaactatagagcaaataaaactgagtaacattatgaaaataataatcctagtatgttagagcacaaaggcatttatgtaaatataataaatgaaaattattctagtatggtaaagattcaccatgctgtaaatttggaaaactctaagcctactgctgagtagctctatgactttgggttagatactacatttgctggcaaatgttttgttttctgttaaacaaaggattggattaacaccaagtttctttccagttttgtgagtaaatatatatttttttattttcaaggagaatacattaaaacaaagcaaaacgaaacctcccatattgacaatgaaaatatttccgcctatggatatttaaaaaacaatgtacttctaagaatgagggtgtcatttcctttctaaaggaaaaaaaagagtattatagaagatgctgtatctggcatataaaataggcagtttcatacgtgaatgaaccatactgaattgaatatagatcaatcaaagaggggtaaaggaagtaagtgaaataaataagttcctaggaagcattcaggcttaaagtttcaagagaaatttaatttataactgcttcagttactcctatgagccaaatttcgtgaaaaactaaagcaaagtaatatttcaatcagaagaccaaacattgaaagaaatataatacaatgcttcaaatactataaccagtttaaccagtcatctctcttgtctttacagaaagccttagataagctaaaataaacaattaggtgtttaataagaaaatggaagaaaatattcagatacggacttttcctccttcagttctgcaaagtgcctccaatacgcagaaaaatatcagcaggattgtgaaaataaaggtagtcatgttgaagtattaactatatttgtgagaaattatacatggttttggcttatttaaatttaatgatggttacatttaattccctaatgtattttagaaaatgtgaaaattaacaaataaaactgcctcttgttatatagtactctcaaatatctaaaaacatttttatagatatctttacaattacagtcatgtaccgcatgatatttcatacattacaatcatgtacctatgatatttcagtcaacaacagactgcacatacaatggttgtctcataagactatttgccatatttgccatatttttactgtacattttctatgtttatatgtgtataaatacacaaatacttaccattgtgttacaattacctcaaataatcagtatagtaaaatgccgtataggtttgcagcctaagagtgaaaggctacaccatgtagcctaggtttacagcaggctatatgatctaggtttgtgcaagtacactccataatgtttgcccagtgagaaagttccccaattacgcatttctcagaacaaccttaagtgatgcatgactgtaacagattcgggttttttttttttaagggtaaatcactgagaaataatttctatgtaatataaatagaaaattgacaaatttattcaattaagatatattaattagttgaaacaggtcaaatattgttttatgtgctgaatattaacaaatattatatgttacttactgaggaaatagcaagtatatacccctcggtcaggaacaagctttaaaagttcatagacaataaaattatgagcttacagaagagtgaacagggtgagggttatagaaaatgagataactacaggagttaggagaataaaagagcagcctttagtcctggtggaaattttggattttactgtaggtgatccaaagctactgggggcaggagggtagtaacgattggttaaatgaccatccattccaacccacacgtattatgctttagtataattcaaggcctgaaaacctgtcacttgtatttattttattatttttcttccctgcaggtacttttctagatgcaggtaagttttgctagttagatgcacttacttgagatttgaaatttgtaaataaggagggtattcttgctgctatagctgttgtaagtctgatcttggagtaggtttgccaaatttagcaaataaacatataagacaatcagttatactttaaacaacacatttttagtataagtacgtccaatgcaatatttagtaaatacttataataaaaaatgtattcgtttatgtcacattccaatataagtaggggttcttttacgtgtttaccctctacttgtagacattgagattttctatgtcaaatcataagctatatgtgtgatgagaaatagttgtcaagtataacaggggccttctcttcccttatttgcaactctaatagagtattcttgaagtaattcctgtggcaatcttgtgactgtggccagtatagccacaacttgtagggaactctgcgtttcccccaatgttgtgtcctgtaggagctcccttgccctgccagttcagcatccttcattcgggagtcaatctcagaggccaaattaaaactgtctgttctaggtcttctgatgacaattcaaattcagttttattgaggcaaaaattatataaaatacactgcaatgatttaaggtatcaaatttgatgagtcttgatagatgtatacacttgtaaaatcggtaccaacaagatataaaatatttttatcacccccaaaattgtactgtgtcctccctcctccctataccatcaacctgcggtcaataatttctccagtttctgttattatagttttcattttctagaatttcatgaaaattgaattacacagtatgtccctttgtatatttttttaaacccagtataatgttgagatttatctatagcgtcatatgtattagtaatttgttactatttactgcagaataatattccactgtataggtatgttatactttgtatattcatttagccatactggtaagtatgaaggatatttccttgtgattttagttggcacttcctcaatggctaataatgttgaacatgttttcaagttcttatctgccatatttatacccttctcagtggaatgcctccttatatattttgctttttattaaataattggttttaaatcttgagtttttagaggtctttatatattttagataaaaatcatgtgtgagataggtgattgatttgtcttttaatcctcttatcgaggtatttgagaaaaaattttacttttgattaattttaaaataatttttcattcataaattgtgcctttggtggcaaatcaaagaactctttgcctagccctagatcttgcaaaattttctctatgtattttcttaaagtcttatagttttgtattttagatataagtccatgctccattttgagttaatgatgtgaatgaggtatgagacctagtttgaggttcattatttgcctttagatgttcagatgttccaaatgtttccacaccatttgttgaaaagctatcttttcttcattaaattgcttttgcaattgtgtcaaaagttagttggatatatttatgttgttctatttttatgtttttcattctgttccatcgatctgcagatctatttttgtgccaatcccacatagtcctgattgctatacattaagtatataaatgggttgacaacttcctccctctttatttctatcaatattattttgtaactattatattttctttgcttctataaataaacttgggaatcatttaatctatataatataaaatcttggtattttagtatgaatttgtcaacatacctatcaactgaaagagaagtcacatctttgctatgttgattcttcaaatctaagacattgtgtctataattatttagatctttgatttcttccatcaaaatttcattattttagcatagtaatcctgtatatgttttgctagaattacacctaagaaaagaattttcttagaatgatttcaaatagttcattttcaattttgatattcatgtgttcatttctagtacagagaaatgcagttgattttttaaatgtttatttggtctcctgtgacgttactgaattcacttattagctctaggatatttttcttttcaattttgtagattctttaagagtttccatataaatacatatcatctgcaaataaggatggcttattgcactagctagaatttttggtactatgttgcatgaaagtattaaaaggaaacattcttattttatgttcaatcttaagatgaatgctttcaatttttcatcattaagtctaatgctggctgtggaatttttgtagatgtctgtggccaagggtcccgattaagccttttttctgactttttctcataattggttgtaaaattttgttaaattctttttcatcaattgatacataatttttcttctttagcctatgtatatattagattacatggattaatttgcacgtattgaactagccttacattcatgacatactgttaagaagttttattattttttattttttgtactgtcttgaacaggttttgatatcagagaaatactagcttattcattaaatgaaattgtgctctcttgatctattttctggaagatattatggacaattgatatcaattcttttttaatcattgggtagacttctccagtggacctggagatttcttgtgggggatatttttactgatcaatttcttttagagttattgggctatgaaaatattgcttttatgtaagttgtggtggtttgtttcttgagcaatgggttcatttcatctaggttgtcctattgacatgtgcatagttgtttgcattatttccttgttatccttttgatgtctacagaatctgtagtgatatactctttttcattcctgatactggtaatttgtgtcctttcctttcttcatccatgtcactggataattgtcacttttatttttccttttttaaattgatttctttgggtttatcttgctctgggttcacccacctccttgagtctataagtttgtcttctgcaaaatttagaaagctttcagctattatttatttgagttttttttaagtctgctcttcttcttctgggacaacaacattacaaatgaattacaaatgtagcagctcaactaatgttgtcaaaacataggtgtttatttagtgttctcatctttataactttttctctaatgctcaaataagcctaatgactttagaactgcttctagaaagatgccaaaggaaaaagataccaagcaattgaaaagaactgggttagagtcaaattgctgcaaaaagcaaaaagctgcaaaaagggatatatagccattctctttctcaagaagtgacattttaatattttcttaagatttctgagaagtaacttagaaagtttttctcttccacagtgacttttgctgaagccatctttggccaaagtagaaaacattttatgttgtctgcattttctaatactaattaaaataatttcaaatgacaatgctagatatcattatcattcatctggaaagtaaaagttattccaataggagacagtaaaatgcttttatattttaagacagagtcttaaaataatttgaaataagtacaccttaactgttaattcagtacattacaatttttgtaagctgttcaacattaaaggaaaagacagatggttatgtaaattgcacaaaaggaaatgcatttgaacaaaagtaagctcattaaaagagctgttttcaccttagaggagaaatctgttctttaaagcaaaaggtttattatttttttttacattctttaatttttttaaggtacatcttttgtggacatcaaattcagttttaatagcatcacacagggaagtaattattcaggaaggccacattctgagactttattgaattcagaggtttgattctttgcacataaacataaaacttcattatctgcacaatatatggcagaatgtatttgttagagaatgagatcattgtttggaaacattcattgtgactgcagctgaaagtaatgaatgtgaaagcaaaccaccaccaaagtaattatgatctgtgtctctatatctttgtctcagagcttattgactgatgtgtctcctatcccaccttcttccatttttctaatggttttatcatcttattatagaaaaaaagaacaaaactattgagtctggcaatgacccaggaccatcactagaaaatgataacattaatagtttagattggctgaaaagtaaacaaaaatataattatactgttaactttatcaaatatagagtataagttttcctaccaaaattgttaatatggatgtagattcagatatagctataaatggataaatagatggacagcaacatagatgggtatatatgcacatataagttaaatatattttcaggtattctcattcacagatattttaaacagcaatgtaattgtaatgatacaattttataggtacatagattgtgtgtatctatagttttttgcatatactacagttatttttatatattttcataaatatatttgtactcctatgtagatatatctctaaaaagatggataatttaatattaacctgagaatatttccaagcatttttctcagttggtccactgaataaaactcaggttcagcaaactcaagtctcttatttttcaaccctctgagaagtatcttgccttcttttgggtagctgtcatgcaaagtcttttgtgactaggggagcaggataagaaatttgagagatggagtgaagaaataaatgagaaggaataaatgcaaagtgagtgatatgatttggctctgcgtccctacccaagtctcatttccaattgtaatccccacatgacagaggagaggcctggtgggagatgattggcttatgggtgcagatttctcccttgctgttatcatgataatgagtgagttctcaggagagctgatgattttaaagtgtggcacttcccctgctcgcgctcgcgctctctctctctcctgccaccatgtaagtggtgccttgcttcccctttaccttctgccacgattgtaagtttcctgtgaccccctagccatattgaactctgagtcaattaaacctttttttttttaaataaattacccattctctagtagtcctttatagctgtgtgaaaacagactaatacaatgaggatgaaaatacaatatatatgtatacctgataaaagagaaatagattgacttaaaaatattactacagaagttctactttcacagtttttgagaaatagatataaaagtaatttaaattattttgagttactaaataacatgagataggttctggtcactggacttttttcttgacacactcaaactgtatcatgacacatccatctatcaatactttagattaactttatcgttttccttttgaattgagagtgtattttcaccatgactgctgatttatcaccgtgttttgcaaaaataaataaataaataaattgctgaagagatagtatggagatcacattaacatttgaatttttttttcttagggaggagactacagatgtgagggttctatatttcaagtagagaccagtaattgcatagcactttttgagtcccctgacttgaattaacctatgaaacaagctgctaaaattatcagccagaaatttgttttcaaccctgggtcaaacactatttattaagaagttctacctagtgggtactactacaggagatagtgattcaaatatgttgcaattaattcaatgtacttgccaaattttacaagttgaaaccaatgcccctgggatcttagccctttttactgacctagttagacatatttttgaattactgaaacaaattttcattaggacctagagaaatttcagagtcctatcttgggtgtaaggggaaaaaaaacacacaacatattgtgttgcagataaatattccatgtagaagtttgatgactgggcacacttacatgtcagaagatgttgctatgtataaaaatgtttttaagtctcaaactgaaagattgtcaaagccaatataactgattttcttctatctacgactgactcatgacctaagaatggatatatacaagcttgtacagtgagtcagattctatatgacaaattctactcttgtattacggctgagaaaaaaaaaaatccactgtgacatacattatgtgaaggaaaataatagaacaagtcctagagctcaaaaacatctcaactttgtctgcatggaagcaatatacaattaagaattggtgtacactactggctttcttgctgccttgatatctcactgttaggaagcctaattagggtaagtataacacagaggtggatctattgatctgcagaacttcctaatgagattcttatctgatagaggaaattgacttggacaaagaggattgatgcagacatggctcttctccttgaatcagtccacttgtaaaaataaggttagacccagagcaggttttagggttaagattgtgtaatactgaccataagaccaactgatatagtcaatgattaaaaagtcattgttttttgcagactttactataaacatggtatgatccaaatctgtgggagtttgtaattgtcacaagtttcaattttaaacaaacagggttatataattacttgctcacatttatttttatttgcacgatgcatattaaatatactttttaaatgattttttatttagacattcattacagtgctccatattttatttaaaaaataacatatagcagacttcacatatttttttccaaggaatatatccagaggcaagtgagaaaaattacagccattcttaataagagaagaaaaaagaaaaaaagaaatgcatttggattataactacagaaattctctattaacatgacaaatataaatagtaggcatctttttgtggaagtctggaaaaaacttaccttggacaactacaacagagtaacacattttaacacattattctttccagctatttcctctcatggacacttgaaatatatttagatttgtgcaatttatttttccctctaattcccagttccccatacaccatctaccattaattgctcagaggaggaccaggttttgcaggatatttaagcttgcagaggggcatgctctggcagaaagggagaaaaggtattcctgagataaacaggctatgctcagaaagaattttattcaggaaatttaaataaaaagagttgaggtttatgacggatagggaaaaaattggaataaatatattgcaggtgattttatgtttctttccttgtgttcaagaaatgttagagaagagtgtgaacattctgaacttgcatattagccctcaaagcatgttctttgattgtgatataacttatgtagacccataattgtaggagctataaactttttctactttattaatatagaggaatatatatatctttgctgagagaaaatcaagctgttgtgtgttttggaagtagatgacatcctttgtttcttgggcagtgtttatatcattagtcatatcattctgcctaaatgtaaatcatcagcacaatacgattccagaaaagtgatatctcaggcaagttatcaacaatttcctaaatcagaacaaaaaaatattattttcctactgaataacatttatcactgaggtagattcccgagattcataagaaatcactgcttttaaaaataatccagttaagtacttgttcttacaaactcttgactgtaagtcaccctatcaccagacagaaaaatagacagatgtaaacaaacatactgaccaaaggtaaagtagaaatatagagtagctacaaaccatacaaccataaacaggaatatctttccaatttcacttagcaaaccaaagaaattttcgaactcagctttttttctgtataatcagctgatagagtaggttttacggaaaagtccgcttcttttttggctgtgccaagcactactaaccactataccttttgtacttattaacataatcttggttttgttcacggcagcaatcctcgtggttaacagccctataacttagattaacttgcaacttgtttcgccaaatgactcataattgggcaatgagttctaagcaagaggtccctgtgaaaactactgtttttgactgaaagatatgagctcagctggcagtaagattttgcccttttgttttctcctttcttcttatccatgattcatatgtgatactctctagtataaaaccatcttatgagtctgaggaagaaagccacacattaacaatggtagaggcaaaaggaagatggaatctggattctcaatggcagcctacgcttagttgtcttgttacttagaaaagaaaaaaagtttcctgatgtagcccctatactcaggtttctgctatagcgttctgtaacacgtgataatttgtaacaagacattaataaaacaagtgttgtattaagttatacatgaaagagcttgcaagttttataagcaccaaaagattacataatacagttaaaagtttactataacttctatatgttttatattaagtgaaagtatcatggccattattaaaatagacattttgacaaaatttacattgtgtttatgagatgtataaatattttaagcaatttattattgactaaaaaactacaaataagcaattatctcaaaagaccaagtgtgcatatgtacttttactgacttatgattacaaaattatatgagctgaatgttaaaaggaatttgaagtcactctgtgtgtatatgtggcggggtggggggaagacctggaatgcaaaacaaagaaataatctattttaaaaagaatctattttattactttaaaatttatttattttaaattgttttaaaacaagaacaattaccaattgagcaatttatttattagcagttgttattagaaaataaattacaattttaaatttagatgaaaatataatgattaatgaaagaagatatatttaacaatataaatagaatatattatatgactggtgtgtctagacttttaaaatcaccagtggtcaattgtactttctggatttgctatgagttgaggataaataatcccatggcttataaaattgacaaaaaaaagaaaagaagtaaaattaagtattttcatagctattttagaaaaaaattcttcacatatatgtagtgtaccattgtataatgcagaaaaatagataatagtaacataacatataattcatcaaatatacaatgttacatcttattttccataatttttaaaagcacctaatttcaatttttaaaaaaaatttttttggaatgaaaatattttgcacgtatctagaaaatacaaagtcctgtaaaagtgttcagtttctggactttagggtagacaggttcaaataagttcatatatccttcttttctttctttcctccttatgtctctctttgactcctttgtctaagtctccttttctccctatctttcctcttccttttttttttaaattttattattattatactttaagttttagggtacatgtgcacaatgtgcaggttagttacatatgtatacatgtgccatgctggtgtgctgcaccaattaactcgttatttagcattaggtatatctcctctttcttcttatgttcctcctccttctcctcttcctcctttttctcctcttcctgtctatctttctgtttaagccctcacctccactagatactcttcaattttgaggattagattttcatatttcatttgcttctcccttggtaactcagtagtaattactgctttctaaaatatagtttcccaaaaggggggaaaataccctttcttcctcaactctacctgtattgtcttttgctccatttaatcatgtcctgtaaatatgcttaaagctaaagaaaatattttaacagaaaaaaattctgtatcttacaggcgatgatgggctttctacttccactatcacatagtactgaaaatgctacttaatatcccctgtttcttgtacttcaacattctcccaaacaaaatttcttactacatgttaggaaaagagtggcaaaacattttcgtttgagttgaggtattaatatttatgaacagattgagatttcctcaaaatgtagtaagaacatttattaactggcccagaagatagtaagtcacaaagtaaccataaaagtgaggtacataaatcaagtagagattaaagctcattgacaaattcttaacatttttctgacgttgtggactaggacctatgggattcgtccattactcaagagaactatatcatcatattaactcatttaaattaatagggactatttcagtttacaacccagggaatggttgaccttctttgcaagatccaccccatgatttcatcgtggctggttaagattagtattaaaatttaacctttcagatctacaattaaatgtaagttacagcacttaagtttggtagcatataaagtttcactatgaaaaatgtgtttccacattttattggaaaatctatgtcatttaattgtttgaaggacaaagcactgataatgtctgttaagatttcactctttttcccttaagcaaaccttcaaaagtcaaatcttatatataaaacatgagaattttatacagcagtctatttcaacaaaattatatatattatataaatatatattatatataatgggttttcagcaagatttcttgaaattgaaactccaataaagttaatgacagaattttaagacaaatactgattacatcttagacactaaagaggaataaaacttaggggaacttgcctgctatattcacatcaatgtaatctttattatcttagatgaaaatgcagggaatatctagcttttgacattaaatctcaaagactagaaatgatagatacaaacataaaatgtagtggttaaaaaataagcaatattgcttaaacacatttcaatatgtctatctagtttataataacttaaatgacagaaaacatgattatttgcaaagtattagaaatggagcagtctttcaataaatgcttctaagttaattaaaaataaatgttaataaatattcaaatacttaaaaaatattctagcacttatttaataatttttacataaaacatacattttctttattcaatgaaagccttaaaatgttggtaatattataaatattaccaaaaacgtataaccttttaaaaaatatatacttacacatatagtatcaatttgaaaattagaaggcagaatacaacagtaaagtaaaatcgttttatgcatatttaacaaaaaggatgacttgttattacatggggggaaacttatttccatctataacagttagaaatctatgttgacagtgacagaaataaatgattaaaaccagtttggacagtcaaataaatttatggcttcatatactgaaggttcccatagaagtttaatatctgatatccaattcttgagtcgttttcaggttttcaccagggagagatatctttttctcttcctttctcagatatgcttctttggtgttaacctccaagaagacgtcaacctttttttgagctacttttaggttctattctagtttcaaaagccccagaaattctgaccaattgactgtgaccatctggaaatacatcatgttcttaatgttctcaatcttaaattatggtcaagagaatggtatgtacatattggattacaattattaaacactgagggccttcacctgaaaattgggagcattctcacccaaacacatgctggaaaagctagtccaacttggtgggggagggagacagagacagcgagagtgagcagagagagagagataaagaagagaagagagagagagaagtgaagaggagaggagggggaggggaggggaggaaaagatagaagacgagaggagagaagagaagaggagagaagacaagagaagaggagagaaaatgcactgaatggatactctggagaggcaacagccaatcggccaacctgaaaatctgccaattcaatttgacagctgccaatccaagggggttcaggaaaaacaaaacatgttttaatgagaaaacaatgtcagttactgaaaagatatacacaagataaatggcctgcaaaaacagaatttctgaaagctctgtgatactatcagccttccaatttttatgttgtttgctttttggcaccagcaaagtcaaaataaagagtaattgaaaacttggttatttaaagtccaaaatagagaaataggggttctcccccgccaaatattgtgtattttatagttacagtctatttatacaaaaatatattccacaggtgaatgattcaattatttgcacatactaaaactataaatttgatatgatttcacaactggagggtaaaaattatggtctgtttaccagcaacttatgtaaccatataacattgagaagccagtataatgcgtaataatgacaatgtcatgatatttctcttaaatgcagtactccttgacggtagagatatataaattacaattaaaatatcttaaaaaatgttaatcatcattggaattcaagttttactagtagttgctcagaaagaaaatacaagcagtgagtgtaatattgttaatgctttacacagcaggaatggaaagccaagagctctcagttacattttgaagctgtttaatactaaaataagaaaattaaatgcaacgcatggctgaatagtaactgagacactgtggaattccaatttcacatttgcagccaatttatctcttcatccttctgaagtagataaattgaatatcacagttaatagtaggatagtacttttgagtaaagccaagtatttgcctattcaacaatgatacagattccattgtgcctttcgtagatcccacggcatattctttaagagcaaaaattaaaaagaggagacaaatttgccagatatgttcccctcttaattgtcttatctggcagagagtaatttctgtcatttctctaatccagaaaagatgtattttgagtctattgaaaatttacatttaagtacttggtaattgtataatgtttttcaagtgacagaaaagtggaattgactaattttttcttcaaaaactttgagcacatatgcatcctcaaaattaaaatgataaggaattggagaaataagagctaagtattctattaagtgactttatatatgaaagttttaaaaattgaggctctcactagccagataattacttgactaataaatactagtgatctaaaaatacacaagaatgtagatattcattagttaactcttttccagttttgtggtttatgtagcaatttaacagacaggcaaaataccttcagaccttcaataagatgatacttcactgtcttaaatttattctggaataaccaaaggtaaaaatttaatagtgaatcacagagcctactctatcacatgaccatgtggtaagatcaaacagatttttgcagactaacatttccagaatgttgtatttttaaataaaatataactgacttttattatgtttctgtttaatattaagataatgttaagaactgatgatataaagaatgaaaagccatgattccaattctcaaagattttaggatttagtagaaatgacacatgtaaatagatgagaagaataccaggtgataaggataaagacaggatatagaaaggatgtgtttttttattaacaaggatgagaggtaaatcagggaagaagtaatgactgagttgaactgtgagtgctataggagactttgttatgtggatgaaagagatgagggtagatgtggatgggatggtaaaagagtcattccagtaagacaagcacacagagtcttggtcatattaggttttcttacaattataaatatagatcgcttttctgaaattcttgattacagatgggtgccaaaattcagatgtttttaaaaagtaatatatttcataaactgaatataacatctcattcagatgtagtctgaagctacatctcataatcaaacataatatttctacagtgaaacatgaatatttacctcatgtggataaatacagtcaaaatgagtcacataataggtccgtataggttttgccatgtggcaaattaccaaaaaaaaatctgtgcttaggattttttctagttttgaaaatttgaataagtgactatagacctataattactcaattcattttaatgggtatataatttttaaaaatgaaaagagaaaatggtggcagataaattggagaatatagcagaagcttgaggtcatagagcagataaatgttagagccaaggtttaaaatgaataagattaagacataagtcaatctttcctgctagatgacacaggtcttatgtgtaggatgatctgaaagctagaaggatcttcaggggattattggacatgattctaatgagagatgatgagaacttgaactgtgatagagaagacaggttcaagaaaataggaagagttagatatcttaatttgatatttaaaaagaaatttacatttgccctaagactgcagttagcaattgaatagaaaaataattgtaatattttaacttaaattcaatgactatatcataaaataaaaaagcatagcactgttgtgattatgtgtatggacacatacacacacacaataattatgtaaattacataacttggttaaggttaaagatataactccctctcaccaccatgaattttttttttaatgtaggtataggtaactttgtgtttagaaagccataactaataaataatatacaagtaattttttaaagatacaaaatatggttaaatccaagataacaaattatcattatgttaatactttactttgaaaggtgtcattattttcaagacgtatcatttaactgatctactttatctagttacccacacctatgacttccataagtgaaatgtctttatcagtgaaaacaaaactagcctggataaatggagtaggattgaagacctaaacaaaaagccattcttgagctgcccaggttgtgtcctgcccacagtggcccccaagatcacctgagtgggaggtgaaatccagcctgctcttcccttcaccaagttgctcaccttgacacgggctgcatcagcctggaggacaggctgcctctcccaagtggttctgccataatggctgaaattttgtaatcattactgggtgaagcagaatgcaatttttcacctttgtagtgggcgtataatttataacaataaaaagagaaaatgatggcagataaaatagagagtatagcagaagctagaagtcatacagctcttaattgttaaagccaagaccctcagtggagggtctgtcaaaggcacctcagtactaatagccactggcggccttgtgctaaactcccctttacttgttcactaccttcataggtttaagggcatcaaatactgctcctttttcatttgtcttccacaaaaccagtttcatgtagtgaaaagaacatgggtatcaccagcactggtgcttgaggttcaagaacatgaatgtctaggtttgagctctgaccttgccactttagagcctaaatgttgccttaggcaatacacagtatactgaagaaaagacaagttctacttaaacaagtcagcaaagcattgtgagccagagttgtcaaatccttataaggatggaaacacatttaaacatttacaaattggctttctcattaaaaatacttcagttctgaaaatcactaaatctatatctaaatttgcatactcagagtgagaaattaccatgtacacgttcattaaatgggtcgctcctatacaattttcctattatacagcctaatttctggcagaacattgaagtacattatttgtacatatattcagataattttagagaccactaggagataaattgttaaagtgaaatcaatttttacactacttaagtatgtaaaaagaaaatatgaattcatcttttacagtgttagcatcttatatatttcatactataatgaaaacaagtataatattagtcaaaacaaataaactttaaaaaatgaatttgtaaaagtccgttcatttgtattagggataacgtgtattcatgtatatgaatggagaaccctggggcaaatcaagaataaaatatacaaaggagactactggtactctatagataatcagaaacaacaaatataaataggctcacactacaaaaatagacttaattacctgtaaaatttggcttaccgaagcttactatgcttagtacttggttaacagtaaagcaactagctttaaagttatcagttagtgaagggtgcagcagctacaaagaggatcaataatactatgcttcatgccatgttaacaaccaggcagcattcagggattccctcatatagtgctatagaccactctgaggaatatgcatagtggataattgggtggaatcataaaagggcaaatagaattttcatcccatataaatatataaatcaagtatgcacatttaagaactgctaggatatcactactgtctgctttctccctctaatcaattctctttacatcaatgtaaataagttagtgtatcagtgatagttgctttacctcctctaccagttagtttcattcaaggtgtggttctcagattgcaagatgaagtaattcacacccctgacatacttaagagtttaattgaacttgttgtgacattaacagcctcctgctataaagcaactatttttagttcttgcaaccatcacaaggggacaagactgcttctggcagtacagagagaagagatggaatgtcaacctatagatgtagttaggtataatagtatagataccacattattgcaataaggattttaggaggcaaacaatgaaatggtccaacatgatgaatgataaaatgataagtaagtgagacattacagaatatatgtctaaatgttagcagcagttacttcggtgcagttacttcagtggattgtaattacaggtttttctctctgtttactttcttattgttgtttcagatataattttattatttatatgttctctgtttaatctcgtcttagttattatgaagtgttattttgataaaaatttagaaaactgaagagaagaatgggtgaaatttaatgaacactaaagttccaggttcttgcacacatttctaagacagtgttcacagatttggctgtgagctttctggcaaccaatgcaaaaaaaaaaaaaaagcaataataataaattataaataattaataaaaatatcatagatcagaaaaaggaagtacttcaggcttcaggcctcatttaggggcaaagataagtatttcttgacaaggtctttaaaagttgtgtttgtaataaatatttttaacaaccatcctttgatataaacagaaacataattattggggctgtttccttaaagagtttgtctacatgaaactatcccaaggatgccagaagtactcatcaagtccctgatgagtaaactgacaattcagtgcacatagtatgtctatacaaaataaagaagcaatgatccttacataatgttttgtaaaaccagcttttgatatatattttgctgtaaagatcagctattagcgatttctgacaaggtacttcaatagagatatttttcactaagcctccatttacatgattcagcagtcaacaaagccagagctgcagctgaatcatcctagaggagctgaaagaagacctgcaaatggatggcaacaacacgtgatcacaggaaacccacgaagagaacaatgatttcccagaaataaaggggtctatttcatacatacaaaggacctacactccaatccattgcacaaataatttatatctgcaaaatgtatgtatggataatgatccttcatgtgaagcttgaggctaaaatataccaatgaagcattcaaggaatatttagctttaggaggtttctatcttgttaaaacttttggaaaaattaagaaaacatacgattttaggaaaactaatgagatcattgccacacagatatattaaataggctagggaaacaatggaggatattacatgtactgatggttgtggtctttggtataggtaaagcaactgtggccagttttccctaaggcggccttcttctaggttgaatggtaagtagttgctgatttttgaccaattggcacctccatgtggcagttttatgtgttttaacctaatagttcatgaggacaaatttattttattcactcatgggagaatctgtctttatgctttctatcaggagttagaatccaggcaataaatatacctacgtgcacatgtaaaattgactctcttattagagaagtagaataggttttacttattcccactctgcatctttctgatttcagtagttgcaatctctagagatcactgtgattatgggtaagatgataatgaccttattccagagggggagtttgtaacctaagctaagtcaataagccctacacacaatcatctattggttcagaaatggatatgttacaatggtgggctaaacagagagaggttggtgactgttgaaagtgttatgcatataaatttgaaagtggaataggataggctgagattatgagggaagactgtcttaaaatgaagtcatgaccaatgaagtaaaagctgacagacagtaatatcgctaaactcttgggtcagcccttgcctgaaggctgaaaggaattctagaccttcagattcataagccaatgaatatgctgtattctgtgtgacaattttagttatgtttttattactttcataataaagtatcttaacacatatgtgaaggcagtcattctatctatatctatctatctatctatataaaatcattaaaaacatattaagaagacatttatgcatccaacagacacatgaaaaaatgctcatcatcactggccatcagagaaatgcaaattaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagacagtgtggcgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggcacatatacaccatggaatactatgtagccataaaaaatgatgagttcatgtcctttgtagggacatggatgaagctggaaaccatcattcctagcaaactatcacaaggacagaaaaccaaacatcacatgttctcactcataggtgggaattgaacaatgagaacacttggacacaggaaggggtacatcacacactggggcctgctgtggggtgggggaaggggggagggatagcattaggagatatacctaatgtaaatgacgagtaaatgggtgcagcacaccaacatgccacatgtatacatatgtaacaaacatgcatgttgtgcacatgtaccctagaacttaaaggataatttaaaaaataaataaattaacataaatacataaatattgtgcaaactattggtaaatttattatgctctatagttccaaaacaatttagattcaaaatcacacaaatatgtgtgtatgtgtgtgtatatatatatatatatatacacatatcttttataattattaagttgccactctagaagtgaagaaattcatgttttatactcacacacacacgcacacacatttgtatgtatacaaattatatttcttctcttctagaatggcaacttaataattatgaaaatgttatatgcagctagtggtaatgagtgctgggtttggatttctgatctggtatatggatactaatgctttgggattctactaatgtgttagatgtaaacagatgtgagacagaagtaaagtggtaggtgggggtgatggggaataatattactgacattccacattttaaacatttccaaatcctctgttaccttgtgaggggaaatcttcattcttaatgacccaaaagttatttcagccattgattatattccaagacagaagtgcctccaccaccagtttctctagttgtggtatgaacctcaatgttcagacaaactgaataacagctgattataactgacaggctttcagagggtctggggtcaaaaataaaagcttttaaagtgacaaatacatgaaatcattaaagaagtggtacctagtagcatgattcaatttgttctaagtaaaaaaaaaaaagaaagaaagaaaaagaaaaaagaaaaaaacaaactgagtaacagaagccagaagctgtcagaggcacttgatatatttctgtgatggcatttgtaatctcaagggattgagcagggagctttatgtggaaatgtgtgtggggtgtgtgtgtcagaaagaaagggagagagggagggagaagagagagagagagaaaaaacaagagctcaagatatagacagagaagtgctaaagtgttttgctgtttgatgaagcaatttttaaaatatcacctaatttgggccttgcaacaaacctacgcagtgtgaagggcagttattattatcctcattttaaaaatgatgaaagggaggctgatgtcctcagtggctaaatgactttagtacagacaaatagctagtgaatggtggtcttgggattatatttcagatcttctgactgcaaagtccttaaaagttttacaactccttcatattataatgcaccactcataaaaaaaattaaatctaaaaagctgctaatatggtttcaaatggaatattttgtcacatcctagactgataaatccagttgtatctatctatatatagttatatatatatctcttcaaatttcctttaggaggtaagattaccatatctatctatctatctatctatctatctatatatatatatatatatacacacatacacattatatatattataaagatatatatctatatctacctatacatacactatacaaagatctctctctctatgttatgtacacacacacatacacacacacacatatacacacacacaactagatttgttagactaggacgtgacaaaataaatataacctggtaaatttattgagagagaaaagaaaaactgtcttttgtaaatgtgtaaataaatatatatatatcttaaagagatatatataaagagataaagagatataattatatatctttataaagagatatatttcttaagatatatctatattatatatagatattgtatattatgtatatattttaaagagatatataaagatatatgtgtaagtacatattaagagatatatataaagatataatatatataaaacatatatattacatctttgtttatccttttgcaaacgacggtttttttttcctctctcaataaaattatcaggttatatttattaaggtgaaaaataaatatatgaagtagtttgcctaaaaccatcttatgtgcttctgaactttctcataaaacacttaaacatttatttggacacctttaggcatctttaaagctactccaaatcttcttctaccctttcaattcccccatgaaagagaataaagccaaataattgttgtctctgtttcgctaccagtgagaagcggccctgtgatccagttctgggtcataaaatatcaatgtaaaaatttgtgcttctgagaaagtttggctttctcacagtaaagaggaaagctttcgtacagattttacttttttcttgctttaaatttgagcacaatgactagagagtcagcagtaatctctccacctaaaggaaagttgaaagcaatccgggaggcagccctgacatgtttgcactactgaaaacatactagcaactgccatcctctggatttgtcttggtgggaggtggaggcagagggaagggaggtgttgtaggttttactgtttatattcattcacatctgaaatatccaaataatgctttttttggtccccaaaactctcgaaactacttaacacatgtgctatgtcactgcttaggacagacaatattaacagcatcatcaggcattttaaatatgcaccattcttacctaagggcaaatgggcccctctcaatcaaagaatgaaaggagtccctatcatgctaacgttcttcagcacctttgcatttctgttgcatcaagtatatggcaccttataagcatcttgttgatgcagactgacttttcagactaacgctatatgctcctgctaagtgactatttgctaccatcgccacctccttttccttatttatgctcttccatctagcagcaatactttctcataattttctcctctgtagcactgcctgttgacgtctaggaatactctttacaagcttatctacagcaatatctcttatttaaagccttgcctgcattatctgtcatttaaagccttgcctggtacttgtaaccaaaattatgttcttccttttaatctccctggggaaattgttactgctcatgtggcattaatatcacacattttctcatattattacgtgcagtagacacattccttgtcatttgcaaaattatcaccctcactcccagtagaccatagagctcgttccctgagggcaggaagagtatgtgattcactttccatagtcatacagtatataccacaaaggtgataggggtgggatagctatgggtaccaaggctgaaagagtttattctctgcaaaaagttattcccttcttcatgccctcctctactgctacaaatttctcaagaatgagaataagcaaagaggaagggctatcttatggatacaattttagagagtttgagatttaagtacaaaatctaaaacagagatttccaaatcagacattttttaaaactacctctgcataatattggcgggggttggaaaattccagcacacaggccaaatccagcccagtgggctgatttgataaagttttattggaacccagccacatatttgtttctataatatctaaatctgcttttgcactataaaggaagagttgagtagatgccagagagacccatacagcctgcaaagcccaaactatttaccctcttgccctttatagaaaaactttgcaaactgttattaggaaggttataaaacaatgttagaaaaacaaatttttagcatttttcttgatggcagaacttctctaaccctttcattactattacaaattttcatatcattttcctgagctgtcaaaattatttccaccacagaaaaatttttaacggaccttatcttctcaggacaagtgatctgaggatcgcatttggcaaatgctgctttaacaaagtgcaagaaaaaacaattgttaaaatgatttgcaggtttctcttcaagtaattgcctcatctgttaatattcaaccctgtgaatgcgcttattattctagtaattttctaggacacaattaagccacatagaaaactgttgtggcccatgataaaagaaatacttaagctcccttcagataaaaagttacagcataccttgtgctataaacaagttaggtggtaattatctgagtgatgtggataattaacatcaaaacagcagcaaatgtacttgagggagaatctatgatgctggacttaaattatttaatctaatttaaatggagtcaggaataccagactttagatacattaatgtggatagatcacacagttataagttccgttagatgtagaacttcccgtatttgcttatagttcttaaattactttctttaacctcagtgttttcccttagaaactatggttggtctcatttatatcccttctaaaataactatgtttctttaacttgaataaacatagtgttgatgtaaaaaggtactaaaacaaaatgtatttttttccagaagttttagaattgtgcacaaattatttagtgatcaaattcatttaaccgaacagtagggaaactgcctttgcaaaaatggtaacagggagaaaattatgacagtgaaagagatctgacctaaccaactccatcttgcctttaacctctaaattgcccttagtcattcctgggcatgggccaagctaactttgggagacatttagtttatagtttacatgataatagtccttcccagaaactaaactgcctttgtaaaactaatgaaagtccaccaggttaggaggctgagaagcgcctgaatattgctaagactcctgtcttggggtctggattgcgacctctttctggtaatataacctcagaccagatgtcttcctattgtcaatggagaggcagcatgatgcagtagaacctactatggctgtgaagtcagacccaggtttgagtctcagtccctctgcttagtattacacaacttaggcttaaacaattaccagtcattgttctagaggttacaagagctgcaacttctctaattatttttgtaattaacatcactatttcagaacctaagatttgctttttaaggtggttctacagacttttgcatttctgacaacctgatgactccacccaggccagggactattctgtggctccaactcagaagcacactcagtccagaaggaccattttccacaccttatcaaccaatcagcaattttcctagccctctgcctgccaaactgtccttgaaaagccctagcctccacattttgtgggaggctgatctgagtagtaataaaactttagtctctcgtttagccagctctacatgtattaaactctctctattgtaactcccctatcttgataaatcagctatatctgggcaagatgaacccattgggtggttagataggtccacaaggaattataactatgctgatgcatgtatactccaaagagactacttagaactatctcacaaagttatattcaatatataaagacccacagcctcagatttatacatcatgaaaacttattgattttatcagaggcattcgaaccaaagagactccgttatgaagaggggctgggaaaaataaggctaagacctattgggctgcatacccaggagattagaccttctcagtcacaggatgagaaaggatgttagctcaaactacaggtcacaaaaacccagctgttaaaacagattacggtaaagaagctgccaaacaaaatctgcccaaaccaagatggtgaagaaagtcacctctggtcatcctcagtagtcattattcactaattataatgcattagcatgctaaaagacactcccaccagagccatgacagcttacaaatgccatggcaacatttggaagttgccctatatggtctaaaacggcagggaggaaccctcagttccaggaattgcccgcccctttcctggaacactcatgagtaatctaccccttgtttagcgcatgatcaagaaataactgttaagtatactcagttaagcagctcatgccactgctctgcctatggagtagcaattctttattcctttactttcttaataaatcaattcttgtacaagggtcaagaaccttctcttggggtctggattgggacccctttccggttacataaccccagaccagaggccttcctgttgtcaacggtgaggccacacgatgcagtagagcctactatggctgcggagtcagacccaagtttgagtctcagtctctgtttcgtattacacaacttaagcctttacatgagaaaaaatatctgacaaataaagttggagtacttgagtacagatactaaaggaactttatctcgtattttctcagtcagtggtataactgggtttcacctattcaacataaaatgtatttttttttttaaatattctttttggtcaatgttttgtttccttgacctgttaagacaactgagaacatcattaataatacctatcaatgtaaaatgttgttttgaataatttatctgttaaatatatttatttaatataattataataagaattttaaagatatataagatatacaaaatgctgtaagaaaaataattaagtaatacaattggagtaaaaaagtaacatcttaggttaagtaattgaaataagtattgaggatatttctgcaaaattaccaaagttgttcataattttcataattcatgctcttgttgatttattacataacaacagtattttaattgtccaaggagagaaacagattttctttgtactaatgtcaggacaaaaatagaaatcacaaaatctcaaaaaggaaaaactaaagatgtcttatgtttttcatgactaccattttacacctctgatgaaactgaatcaaaatggcctcatcattattagtcatcatttgtacacactcttactacgcaagcggattgaaaaggtgtacgtgtagagtacttaccctaatccttcaaggaatttcttacacagaagggtagagaattgagaactgttacatattagagtgtttgtattggaaattttgatactggtctataattatctatttatctatccgtcatctatccatttgtgcatatgaaaacatatgaacctatatggtattaataattattaaataataagctgtttgtgctacatttttatttgaatgtcctgaaagaaagtttatcataaactcacctgaactctaaatagcaagaatcttggggacatgaaaattttgtcttttcaagtattcgtttcatgattttgtatactcaacaaacgatgaaattataactttaaaacaatttcatgtgatttttttgcatgaaaaaattatatctgaaatatattgttacataggaaattaaatatgcatatatgaggaataaaattatggttgaaaaatataaagcctaaggctcagcctcaaatctgtttaagtgtactgacacagaaatgtcttaggtacgcagagaaggacctatagcacttttaaaacttgagcatattatttaaaatataatttattattactaaaagagaatgttatttcaaatctttatttttataaaaactccacaaatccccctgcaaaacagcattttatacattaaaaagtataaaatggtaaaattatttttatttttagtattttaacatattcagtagcaaatagtagtaaatgcctactttgccacagctttatgataaatgctattcatatactcgtggatgaaagagagttttttcattttttctggagccaggagcaagagataaattaagcaagtatgataagcagtcatgtgtttatatacacataacatatatgtgtatcataaattgcaaattacagttatatatttcttctttaataatatttgatttccttaaacatgttccagttctgagtttttatttataaattttattcattactaccttgatttcatagacattattctatttctgtacctttttccataaatttctatttcggattctatttcaatggatttaaaacattataataccactaaaatacaattctcctaactttcactgaagctattgttacccaaattttattttaatttctattttgttgctccaatgttataaaagctatttcttctgtaattgaagcacaagcctcacttcagaaacacataaaagaaaattgattttcatcctgaaaatgtcaaacttctgcctataatactcagctatggttttctgaaacaacaaagttcaaaaagagccatcgacctgatggccctttgacacacaatgatggatgcaatgtgtctactactttactgccagaatgttctctccaagagaatgaaacaatcaatgaagaataataaatctaaactgggtagaaggtttgcttgttttaaatgtactaaaagagaaacaacaggtatttcacttctctagggaaagacatttatttactacttgattaactattttctctccgtctagcttatgtgaatccaacataacatatatctgcttaaagacattgagcaatgcctggaaatttaattccatacacagttcttgaacttactgtgaaatatagatgtaatgtattgttattcttcaaaggagaaggaaaaaattataaaggaggataccactttactcaccctagtgtcgtgtccttttgtcaacctctaggtctgtcaacttcaactgtttctagggaatgatgtttccattttcctgtagaatagagttattgatcaataccacatcaaaatcaaagtcgttactctagtgcaaaacataggagcaattcattttcttacagattatgattatattaagatttcttgtgcttaaaataaattcttgcaaattatcaaaagtaaatgagtaaaagattgcaagaatcttaaatataagtttggaagtggaagacttaagtctaatttaaaacttaactcttagaatgcatatctatgcctcaggttatattctttacccaggaaatgaaaaaccacttccacctgcatatttggtatgaccagagtctgccatttcaccagtcttaacaacgaagcactgcataaattctccttaaatgacacttcaaatatatgatgttttatgatatggtgtacatattcaagacaattaaggacaattatatagattgaaagttacttttgattccttagcatttttattttattttgttttgagacagggtcttgccctgttgcccagattggagtgcagtggcacaatcacagctcactgcagcctcaaccacctgggctcaagctattctcccacctcagcctcccgagtagctggaactacagatatgtgccaccatactcaggtcatttttatattttttgtacagtttcgtagttttgccatgttgcccaggcttgtctcaaacttctgggctcaagtgattctcccaccttggcctccaaaggtgctgggcttacaggtgtgagtcacccagcaatacagcacttttggatttcaaaattttatactataccattattattttataccaataattttattattgccacaggggcacagcttttgtatttatgctttgtcaaagtagaaataaattaattttatgatgatgtaatataaaattgaagttataaaagttgttaagaaattttaacattggtatctttctactgtgttttgatttcaaagttagagaacatgtctcaattattcacatctctcatgcacatgtcaagaaataggtacagaaatagatggaaatagctatattttgtttcaaacacacaaacatgtagaatataaaattgacagatgcatttaatttatggaaaacaaaacaatgatttatttcttacaaccaaagtttggttgtgatctgctgaataagtggaaataattagaaagaattgttattttacaatggttctaaggtgaactacattaaataacatcctgaaaaaggagatgaatatttataaaaatctagcgcatataaattaaaattttaaaatactttcttttcatagatatataaagatctctacataaaataaaaattaagaaatgcatacaagtcaatttttataatactttggggattaatgtatatctatcttaaaggagaaaataaatagtactatattcaaaatataaaaacaataagcagtgtattcagcactttttcacaataaaatttaagcttaatagcaatatgtaaaacatagcagcaaatcctttccagacaaattatggatgaggtgtgatgggatcttctaaatatttgccaccaccacccctatccccgaccccaagcccagtgtggccccttggtagcatatgagacaattttatacaactccaagtttccatagaacaaatttggaaaactcttgatataaatcatttttaacattctttaataatgaaagctataaaatggatattgcaaagacttaagtaaaattttctcaatttgtttaatcaacaataaccacaataggaggaaagtttatgcagtgacctcctgactggacattagctctgagtgtagcatcaaacaccagaaatagctagatattcccctaggggttctgtacatttgtgaacagtgctgaaccttcaattagcctcattctaaggaaggcattttgcactgtgctttgtgtcgatttagtaatacagtgggtggcttatgatttctgagtcatcattacacatttcataaaatatagcagaaattgtagatttaaaaattaacacttaaagcatttaatgccttcaggtcaggggataaaagatgaatgaaagattatcttttatgtgtacagtatatgtaattatgattatataagaattaatttcatgtgattgtgcacgcattttatcaatatagttccaaagaccaaattattacttaaatgctgacttttaaaacatttctgatactctagatttggggagttataaattagatcttaaatagagagtgtaggatttcaattaaacaaataatttatgtttataaagattggaaaataggataaaagtcatatcttagagtgagtaccaactctctgtggtatttcacttattgtgaatcttaatttttaaaaacttgtttttctagattgatatttcaacagtaccgttctggagttctacctaataccgaaaataaacatttttaaccgctcttaactacttcaatattagctagaataaataagaaaagaagagattctattaatttaaagcatacaatttcccacggattgctttggaaatgtgtggtataatgaacctaaactagtattaaaatgtagtcattgcacagtgtatatatatttgaaaacgtcgtgttgcacacagtaaacacaattttatctgtcaattaaaaaatcaattgctaagaaatacattgtttcctttaaaaaatgtgttattcatgattaatctctatgttgtagtaatacagtatttaaccaacaagattcattatttaactacatttcaaccctttaaaggtgtcactaaatgtgcaacagcagaaaggtttatactgtgatctaattgaacaccattccaccttcaaccaaacctgaataatcaattaaaatttattaacataaaagcaggttttataaaaggcagtttcagtcttcataaccactatccacaaaagggcaatactttgatttgtgaagccataattaaacactagagaactacaaattgatacaaatatgaaactacgtcatatgttgctatgtaagtacaagggtggttgtaggcatttatattactaactgccaattatcagaggtaattacaataaacaaaaaacaaatatgcacctaggtgtgaagtggaaatagcaaacattagtataattaattgaattttgaaaatccttaaggataccaaaattaatgtgatttaaataataagaagatttacctttctacataaataatgttattaaccattagtagacataaaattctatgagtcaaattccatagactgttacttaaatttactgatagaataaaggaaggaaggaaggaaggaaggaaaggaggaggaaggacattaagtaggcagtgagggaaggagtagaagagaacttgatgctttacaatgctacagattttttaatttgaacctacttgaattttgaatgttttattgttgttgatgtgggttttgttttatttgttttgctttttggtacagtgtctcactcactctgtgacccaggctgaagtacagtggcatcattatggctcactacaggcttgacctcctgggctcaagcaatcctcctgcctcagccccccaggtagctgagaatacagatgtatgccaccatattggctatttaaaaaaaaaaattgcagagacaagtcttgatatgttggccagttctgtttcaaactccttggctcaagtgatcctcttggctaagcctcccaaagtgctatgattacaggaatgagccaccgtgccagccttaaaggtgtcttaaagctggagagatgataataccactaccacccccttttccgaatgaaggaaaagagaaaaatgtgctaagaaattttttaaaatgtgattcctagtagcaggtatatgtacagggcacactggtagaaagcataattgatggccgagtgcagtggcttacacctgtaattccagcactttgggaggctgaggtgggtggatcacgaggtcaggagttcgagactagcctgaccaacatggtgaaaccccgtctccactaaaaatacaaaaattagctgggcgtggtggcatgcgcctgtaatctcagctacacaggaggctgaggcaggagaattccttgaacctgggaggcggaggttgcagtgagccaagatcgcaccattgcactccagcctgggcgacacagggagactccatctcaaaaaaaagaaaaaaagaaaaagaaaaagaaagcgtaattgatttttctcttagtatattttcttttttggattccaggatacctcacttcctgatgtatctcctacatttctggttccttttttgctggtcctttctcatttctccatctctcaataatagaatgccctagggcactgaccttaactttcttctcatttctacatataataatattctagctgtttttattcaacctatggaattaaacatcatctaaatctcaaaaacaccaaaattagcatgtcagtctactaccctccagctttttccttcacatctaatttaaggtctgtagtcatgtcaaaattaatatggccaatgccaagctactgattcttacagctcttctactctgtataaatagcaattctattatttcaccagcttaggcctaaatgatgcattcatacacatgaagcctcaaagttaaaattcactatttcttgaatctttttcatccaacatttctatgttcatgatatagtcccaaagtcctaatgactcataaattgtgttattattcttttcatccttctagtaacttcattcagcttaatgaaatccccacttattttaggccacgataatataaggcagtggaggggattaaaattaaaaaaacaacgacataaaagaaaaatggaaagaaatttaagataataaggagggggccatcctactctgctatttggcatttgaccaagttctttgcctaattacactttaattttcatatttatatagtaagtattttggtatgatttctaatatgtctttcagatctgtgattcaagactacacaattttatgtcagaagttgatactgacttcaagaattaatattagtcatttggtagtagattgttacattaataaggatttgattagtgatctagaaaaaaaatgctatgttcaagatgttgaatggctaaatagtagtgatgtacgccaaacaatgttcacatcagcagtatatttaaccagaaaagaaaaaaaaaatcaatgccaacaagcttttattaaaaatgccttcttcaaaccaataaataatttcagaaatatgttggatattacatttcaaaacttttagaaacaataacataaactcttcctggttgctgtggaatggattttatgaccacttatctttatgtaaatctagagattttttcaaaagattaaagtattgtgcttgcttttctcaacaccataaataatataaaatataaattgtcaagagaataaatttatatttcataaaaatgtcagtattaatagggaaccttgactgacaaaaatgaacacctaaacagaaaaagaaactcttactcactataattatttattggcattatttcttaaacgtaagtactcctctaattaaaatattgcagcttttttttcaagataaaagtacaaaagtgtacaaataaaggcatgacctttgatttttgaattttttttctgagtaaaagatagggcataatatcctagaaacagctaagagaacagtgttttgttcaaaactaaagtgattaataaatgacttttgagaaagcttactattttgcataacaagatgtgcaatgaatggccacttcagagcatttggatattataaatcattataacaccattttgaaatttaaaaggccttctaatactcagcatgctacaataactccatgaaattatttttggcatacttcaagagtatgtatttagtcattacattttcctgctgagagagttcacacagaacacactattctttaaattatgttttatagaatatttatggtatcattaggatgtaacaaaaaaactaaaaagtgcccaaaggagagatggggcctatgtatgttaaaacaaggacaaaatttaaatatatatatatctattacatatgtatttcttttagattgtctctgcttgagaaagctgttattagaaaaagggcaccatctttgagagttgcaagcacttttagaagttctaaaagccttttaaatgcaaaggtctacaaaaaaggtttgttttatgcaaatttaagcaagtcagctgaatcatattgcaaagatgaatggctgcttattttgattcagattttaggtcattctttcacatacaaatggccatataactgtatttgactaatgctggggacatgtatcaattctgcaaaaaattgattttgctttgtaattggcaattaaaaaaaacactttagaattccttgccacttttttttttaacctccaggtaacatactgaatctttacatttaaattggcaaaggtccaataaggacttagagaactattttaagtcatagggaggggaagtgacaaaataggaatcctttgattctatattagaaagattatgtgtgtgtgtgtgtgtgtgtgtgtgtgtgtgtgtgtatgtgtatgtagaaggatgggggttaggaagactgtgcttataaacatcttctttaagatatgtaaaaatttatatgcccattcattgttttgcaaccttccctgatttccctaatctcatagaaaatcatagttaatttcataggtaaaaattaatatgacatcgtttaatttgtagtttttacatacatgtgtggttgaaagctttaatgcatttgcttttcttaaaattatcaactttctcaatttatccgtttaaaaaaactattgtataactttttagcatataaaaagttattagagatatttattgagccagtattcatgttgtttacatttttgctagattccttttcttagtttgtagtatgatttcattctgcagcatttgacataaatgtgaaatgtttatatgttaaaaatgtatcatttttcctttgcgttttttcttcccttaaactgaaactttactccttagtacagattttttgatgtttcattcatctatctattttcatattagaaaatttataccaatacatttaatgtatatgaaattgattttgatgtaaggtaagtgtttatgggtccaaatatgaattactgcatttcaaagctttattatttcacactttatggtacattttgctgatccatcatggaaacaaaaatattcaattttatagacaaaagtagatctttgctataaaagtagaattatattctcaaatccttgataatagaatactgttgtataactattcttcattaccatgacatgaaatcgattttaaattgataaatgcttacttttcttttttggaaggcatcttttagtttggaatttagatgtgaaaactactaccaattgaatactgatgctagcaacaggagacaggcaaattcctaggcagaaaggactcagggtccccactgaaacccgatcttgaaggcaaggacaatttaaagcctgaaaaccaggctgccagttctgaagaatccacgaccagagtgagaacttctatcctcatcttacccactctctctagatttgcttataattcagcttggccgaattataaactgcaggacagagaagcttggcctccagaggaaagtattttcacactgtcctgcagctggaccttttctgtaaatgagatggccaaagtgtccaaggtcgcatatgtgcaggctttctttgccttgcatgatattccaaagctttgccaacattgtagaattgatctagccctcctagtggtcatctcaggagaggctgcaaacggcaatctcaagggacaagggaagcaaattccagagctgcctccagcaggcgagtccagtttctctggtcctgttcctcctgatccatcctgtcctccctatccatgttctttcttaacttgtcccatcctagaaatcctcattttaagtgggtcccagcctcactcatgcccctataagagatgccttgtgaatatggccctattaaggtttaggtccccttttctctacaagacttaagacaaattaagggggatcatgttaagttttcagactaccctggcaggtatatagcagctttccagaatttaacccaagcatttgaaatctcctggaaggatgttatgttacttttgactaccactgagaagcaggccgacttacaaacagcagagaagtttggggatgagcttagttttccatatagtgccaagaaaggggaagaaccttatccaattggaaaaacagcagtaccattggaggaccctaaatgggaccccaaagaagacacaggagaatgaagaaggaagcactttcagatgtgcatagcggagggcttatgaaggactaacactaagcctctcagttactccaaactatccatgatagactagggatcagatgaaaattccactgccatcctggaaaggctaagagagtccttggtaaagcatgccactctacctcctgattcaatcaaggtacaactaatcctaaaggataagtttattattcaggcagaacctgatattaggaggaagctacagaaacaggctatgggaccagatagtactttagaggtgggtgaatcacaaggtcaggagtttgagaccagcctgaccaacatgctgaaactccgtctctactaaaaacacaaaaatttcccgggcatggtggtgtgtgcctataatcccaggtacttggggggtggctggcgcaagagaatcactttaacccgggaggcagaggttgcagtgagccaagattgcgccactgcactccagcctgggcaacagagagactctgtctcaaaaaaaaaaaaaaagaaaaagaaaaaaaaagaaaagaaaaaagaaaaagaaaagaaaagaaaacctcctgaaaatagccacctcagtcttttataatagggctcaggaggacactcaagaaagaggagagagaaaaaggcagaggttctagtggctacattgtaggtttgcaaaccccagaatccctgagatgtacctcttaactgctatacgtgtggcagccagggcactataagaaggactgtgcaggaaacatggggaagccaccttaaccctctccagtctgcagtggggaccactgtagggtggactgtcccgggagatgcaggttaccgggtacagatagtctcccaaatagtcaagcaggactgatgggtccaagggctcctctctccagctccgacgactcagaccaccattaccatccaggagcccagggtgattctagaggttgaagggaggaagataacttcctcctggatataggagtggccatttctgttctcctctccaatccaggcttcttctcctccctcagtacgaccatgaggggtgtctcaggacgatacttttcccaacccattagttgtagttgggaaaacctcttgtttactcctgccttttaaatcatgcctgaaaacttaactcctcagctaggcagggatattttagctcctatgggaaccaccatccttatggttccagggtatactctttgtcttccccctggtggagactgatattaactcaaaagtttgggcaactcaagggaaaattggctgggccacaactgccatacctgtccagatccattgtaaagatccaaccttttttcctaaccagagacaagatcccaaaaaccagaagccaggaaaaagctagaatcaatcaatgataacttgatgttccagggcatcttcaaaccctgcaacaacccttgtaatgccctgatattgagggtacagaaacccaataagaaatggagacgttccaggatcactacctcattaatgacgttgtggttctaattcatcttgtggttcccaatccctatatcctgctaactcaagtacctgaggatactaaattgttcacagtcctggacctaaaggatgcttttttcctgcataccactacaccctgacttccaatatttctttgcattcgaggatccttgcaaccagactacccagctaacttggatggtattaccacagagattctgagacaggccctacctgtttgggcaggcattgtcaagggatctctctttatccacaatttaaagttttataatatgtagatgacattctccattgtgccccaactgaggaaatctctcaggaggggtataaggctcttcttaattttctagctgacagaagatgtaagatctcaaaatttaaggctcggctctatcagacttcagtgaagtacttaggtttagtcttgtcagagggaaccagggcattaggcaaagaaaagattaagctcatctcctccttttccctcccctaaatcttcaagcaactgaggggattcatgggcattagagtattctccagattatggatacctgggtatgatgagatagctcatccctttatcacctaaaaaaggaagctcagacagctaatttgggaaccagaggctaaaagggtctttgaccaattgaaacaagccttgtctgaggcatcagccgttagtcttcccattgggaagccgttcaatccttatggatcagaaaggaagagaatggccctgggagttctaacccaggtccaagatccagtccagcagcctgtaggctatctaagcaaggagcttgatttggtggctaaaggatggccggcctgcctctgggcagttgcagtggtaactttgctggtgccagaggctactaagttaacgatggggaataacttaactgtttataccctacataatgtggcaggactgctgtcttccatgaggagtctccagctaacatacaaccatctcctcaaatatcaagctctgctattggagggatctacagtccagttaagaaggtgtcactgtcaaaactcagccaccttccttccagaaaaagctggggaacctgaacatgactgcaaacagatagtagtacaaatctatgcagccagagagaacctcaaagaaactaccttggagaacccagattggactctttttacagacggattttttttatagaacaagagatccataaagcagggtatgcagtagtcaccctgaatgacactattgagagcacacctctttcttcgagcacaagtgctcaactagttcagctaattgtcctcataaaaatgtttgaattaagcaaagggaaagcagtttacaattatactgattctaagtatgttttcctaatcctccatgcccatgccaatatctggaaagagagagacttcctcatagctaattggtctccctttaaacaccatcaggaaattaacagactattattctaggttttccttccattggcagtggcattgatacattgtgaaggccaccaaaaatgggtggatgaaacagccaagggaaatacattggcagaccaagcagctaaattggcagtgagagttccacagatatctgatccacttgaggcctctaatctgggagggctgcataagagaaataaaacttcaatattcttctgaggaaatagaatgggccacctcttgggaatacacctttcagccctcaggatgactacaatcagagtatggcaaacttcatccagcagctttcagccaatggaaagttcttcaaatccttcaccaagccttccacctaggaaaggattaaacctatcaattagcccagtggttgttctcaggtctgggttgggagggaccttacagtgtacttctttctacttcttcagcagtgaagatcactggaatagattcttggatatattatactagagtaaaggcctggggaacttatggaattatctctgttgacccagagagcactcaaagcaccaatgtaaagaaattggaaacctgaagctaaagatcataagtgtcagtaattcacctttcatggatatcctttatagtcctgcctatgattgctgttctcaccttcattctgttcctcaccattaggtgtctttgccaaggacccctaatcctgaatgcccatgggattatctactcccctaaacagaaatctcttttctaaaatttaactgccctcccccaaattagatttaatttctttcacaagggtgaaactgctctggccacaacattgttttcagaatgattagtctattttacttcttatttctgttatctctggcacaagattattcccttttagctcctttttgtataatactcatatatggttcatgcatacttaacctccttgtaaaatttgtttctttttggctaaaggccatcaaactccaaatgatcatgtaaatggagcctcagatgatggctccctttttactggggacccttagataggcctctgagagatatctgacagctgttttcccaaaacaattccccccgtcggcaggaagcagttagagcagtcattgtccctatcctaatggaagttagatgcacctcttcagaggggggattgatagtgaaaggatacagacgaattcctaggcagacagggtccctccctaggacaggtctcaaccttcaagccaggatagtttgaagcctgaaaactgagatgccagttctggatagagtccatgaccagagtgagaatttctgtccccggtttacccactctccctcaatttgttccttctcgatgataccttttaaccaaactttttccaagcctgctcatggacaattcagcacacactcccccccattctaagcccatagaaacctggactcagccacaaagttagcttacccacttacaggtcccctcagatgctgagagcttagtttctgtcgctcaatacaattctactctgccttactcactctctgatttccacgtaccctattcctcttggttgtgggacaagaacctagaatttgctgaactgcaggagtgaaaggggtgtattgtttctgcttgctgatctgcaggtggcaggagtaaaagagctgtaacactctctcccacttgctgaacaatgggagagaagtggcaactgggtgacactccctcctgcttgctgaactacgggagtgaaaaacctgcaacagtagcagtaagaatctctcagaaattcaaaactgtgcatagatgtgcctaagatacaaagaataataaacacatttctattctaagggagtttttaaatctaggagataagttggctcttgttcacatatacctacaattcaagcagaatgggaaaactcaccagaacattctggaaagctgagaagattcagggaaggaactggtcaggaagaagtcacaaaatggctttaaagaactctgagaagttggagagggatttggcagatggtgaaacccacaagagaagtacaaagtaaagagagagaaaatcagaatcatgaagtatcaaaagccaggaaaatctgataatttgtaaataatgtaggctggctccagttgtacaattgtagaaagtttggggaacaggtcacaaaatgacttcttacaatacctaaagaccctggattctatacctttgagatggaaagttttaattttattgcttctaataagagaccgtctcaccagtatgtgctttagataagttaaggtagaagcaaatttattgtaaaaggggaaatagttaagaagctattgtattaattcactcatctattcacttgtccatctattcaacagtgatttatgaaatgcctgctatgaatcaggcattgtcctgagttatgcaccacagaaaggcatagagtgcaataactcaggtaagattaaggtcataaattagatgagaatatgtctttctaatatgacaaaaacacagaaactataaaatgatagattgtaaatttgtttgcatatttatacatttgccttcatggcaaaaatatcatgaaattaaatcaaatgtaattttggggaaaacaaaactcacatttcagttgcagatgcctgtctccaacacttccagctacctttctaaaagtgtttgttttgagttaacacttatatggcactctttctgttctatgtttgttttattttagcccagttggaataaaaataccttggctgtcatgttcctagagggggaaaactcagagaaaaaaaacatatttttttaatactaaaagatatggctttgaacagattattccaggggctatgacagacacctagatgattaggaattgggacttactttagatagtgtggaaaagaagagtagttctggcaaagtgatatttaaaatgaggcctaaaatatgtgaagagaatagaagtctgagggaaaaatcatttcaggtggcaagaataaagcaagtaaaagccatgctgtgaaaatgaacaaatacagtctgacattctgtgatttataattctttaggctttgggctttggccagcatattataattattgttttgccttttttaagtgaaaaatttttaagtattgggttaaccatactcttttgcttatgaccattaaacaaatgggttaccaaagtaatgagctctactaaaattatgtattgaatttgaactcttctgttaaaatatactaattaatgtttctttctattgtgatgatacattgggtctaagttttcccattaggataaaattggcaccttgatccacaattatgccaggtagtacatcatcttcatttaagtagatatttaaaggatcttcatcactcatctgtttcattgttagtttttaaggactattttaaatttattgacgataattttctaagagtgtcaacatttttaaagatcttgaactgtttaaaaaagaaggctaacattggaggaccctacaccaattcaaaatcattttgtgtataaatgcatatattatgtgcacttctatattaaactaaaaagaggcctaatgagatgtagattaaaactgattttctgatttttaaaagctgaatattcctttaaagccttgttcttgtgaactaaaataatttttaatacagaggtatttaagtaggattttataaatttaaaatgttagatgtctcagaagaaaatttggggaatactgttttattaatgttatcgacctatccccaacactttactagacttaaatctctataatctaattttctgtatcaagattgtccttcttcagaagttttggtgattgaggagaagatccagggtttcaacatgatgaaccgtgtcttgttctcagcaaacataataaaagagaacttagtattatataatagaatctgggagaaaacaagattcttggcattctgaggttttctagcatgaggatacttattttacatgcaggcttcagggaggtatattggaaagttagtaactgtgccatgttattttctctttagatatttggaaacaaaaccaaaaggacaccagtaacaagtgaataaaaataactacaaaaaattacacctgacttcaaagtataaaattactcttctatcctacttttctgtatctaccattaatacacagactttctcttaccacctaaacaaacacatatgtacatgcacacacacacttgcacttgctcatgaatacaacatatcatagtggttaataacacaaactctaaaatcattccacctggaattaagtcttggctttgtcactgatcgctgtcaacttggacaggttactttacctatcagtccttactttcctcatccataagcagatctataaagcatattctagcctatgttgttagattaaatgaattggtatatgcaaattacctagaccagtgactatcaaacagtaagtaatacataagtacagatggtatgtatgatgtaagtgttaaatgacatcattagcatgattaccgttttaatgcatagcagcacaaagtctatggaaagaaaacaggaggaaaactgtgggatttcattgggaggaaagaaatgatgtacttttagttccgagaaatgacttgtgttcagtcaagttaggaaatcatttagcaagaccttgtgacaaagcaggcaagaaagtgagaaagaaactgaaggatatttaaatttttgtgattttaaaagcaaagtgagccaatggtctgtatccaatccaggtgggcagaaactgtgcagcccagatagaaacatgtagcactacccttggtcactctaaatatggactccttccttatggcttcacatctatattctcatctgatgcccaaatccattatgagatatagatatggtatatatttatattattgtacagaggaagcagttgattttgaaaaagttgttacttatctaatgtcaaaatctattcagttttagaaatagaatttgaagctacttctcagtttcatatattttgcattataccatttgtccttatgaatgtctcattttagaaatattgtcaagtgttttaagggatagtaatatcaccatcattaagaatatgtcctgatataaaaacatagtagcaatttccacatcttgatacatattgtaaattatcattgatgaaataaaaaatctgagataagtttcagaactattcctgaaacatgtacacaatgtggcttttaagaaaagcgctctatacacccaataaattaacccaaaataagctggttttcatggtgcacacctgtaatcttagctatacaggaggattgcttgagcccaggagttcaagactagcctgggaaacactgtgagaccctgtctcaaaataacataaaatgaaataaccaaaaacaagaaaaaaattaaactcaaaaactaaaactgcttacattgttttttcagaggaaaggcgggggtaacaacattaaaacctattttttttttctaattgaaaaagaatggtttatgctatcagatgaatgcctccagcagaatgtaatttggttaagacattattggtaatgctgtatgtgggatgaccacacgttttgtttgtcctggacagtactagtttatccctatttgccttgcatcacttctgttagcctttgtctcagatttttcaattaaaaattattattaataattacatttaaaaaggttagagttattttggcaatcctcactttgtacttctagctgtgaaaatataaatggattgagaacagcatccatactttaacacacggtcaagtaagctatcaggtttacctctctttttctgatgctttccaggagccgtataactcttggtaatattttacagacagtgtatgtgaccctgcatggtaaaaggcagtggtgggagaagtattcagagctggtaactaaggtctcaacttggccctccagctagatgtggttttatgcatcctcagcttgtgaaatgctgaaaaccacaaagcactggtggtagctggtgaggctggtggaacaatgagacaattatagttttggtgcatgtgaaataactacaggaaatatggactcatccgtactgccatagagaatatagagagtggtgtgaggactcactacaaaggacttgtcatttattgtttggtgaaaatctatactgttcaattatttactattttagtgcttatttatttttaagccataaactccatctgcaacaataaacagtctcactccccaaaaatgcatttataatacaaattaagaaataaatttccatttctcaagaaagttgatgaataatatgttacttgtacacaatgtctgttgacatttacgatacttatcactcacacagaaagtggaagaaaaagacaaaattgctcaagaagcaataccatcaattttacaaataagtagctatattaagacagtgctctaaaataaagatttaacacatacagctgtagagggtatattttcatagcatttgggaagcatgatattttatttaaatcaaatgacttttcctcaaaattaaacttgatcttttttattctaagatttatgacacatgcacacaaagttaaaccacggatatcagttccattaatatataagaatttcaaaattgtcaaatattgccacatttatcaaataatgccaaatagaaaatgagttaaactaattttaataatggattgattatttcatggaattcagaaatcaaagtaaacattttagaagttccttcagttggatgtgaaaattctaccattattaagaattccaatagaaagtcagttaagtaatccattatttaaggtaaaataacttgcttttgtggcaataatattaaaaacatttttgaagcacagagtcatagtgaaaacaatgtttaaccacattaagaaaccaataaactgaaattgtatttggaatttaatagaaactgttttgtaaacctaaaatatatttctatacccagagatataggacaccaaagatttgagacaaaacaaatgtttaggtggtatacactttgtctgtttgtagctcattatctataagatgttagaaatatttgaggctttaatgacctagtttgtaaatgatgttgcatgtcttaaaatgttattgaaactttctataaactaggcctcttaaatttgcttaaattttgtattaaaaatcagctcagaatctttattaaaagactttgatgagtgcaacatcaaataagtaatcttttgaagcttctagtaagttttagttatcaagaataaagattgctaggaggaagagaaatatcagtatatctctacaaaaatatgaggagttgagcaagttaaaaataaaaagtcagtgagtaagattttattttcaaattatataaattttctttagaatattatgtggaaagaatcatttgacagggcttctatttttatttggatacagtgttttgttttctatgcatgaacagaacaccttgacaggttttctcagttttgcagcctcgaaggttgacaaaacattcaaaacaatcacaaacgaaggtaatatatattgagttttgttatatgaaaatatttgtcataaagaggccctctgcatggaggaaaagaacagtacctgtaaaactgtttggattgaaatatttatacatttgaatatttacatatttcaatacaaaaatagaaatagttacgcatttcaatatgaaaaaaataatactgtttatcctctatgtattagtatttgtttgggacttggaaattatcaaaaggattttctccttcagaaacaaatgatctacagagaaaagtcatcaaggatgtcaacaatttcatttttattaatcataaaacaaatgttagaagactgaagcctatttgagtaaataaattaaaatttataagactatattgaaaaaatacattatttgactaaatataatgcaaatgattttagtcatacagataaataaagaatggattaaagtacataaaaatgtactggctaattattaattattccactctatgttttttatttttagatgaacaatatttaaaaaaaaactttttgctttatgtacgggacatttttctttgtattttttaaaaaaccaattgaactgtttaaaacagcctaaaagaagatttcaacatctgccactataataaaatcaaatataattaataaatacatatatatacaataattttaatagtttgcctactgtctttcattcatagacgtatcctggtttggacaaactattaggtgtttgctttaactttaaattagtcaatcagttggcagaatagacaactaatatgagactaccaaaagtgtagtctgctttcacagctgctagtaaacattttcctaaaaatttttatttagaaaaaacttacatttttaaaaaatctataaattttagatttgtgccatgcacaaccatgtacatttacatagaactaccagtctttaacagtttaccacatactctcctctgtgtgtgtgtgtgtgtatttttttttcctgaaaaatttgctagtaagttgctgatattgtagcacttcaataaattagactcatcagatactgttttatgcttcagtacttagttggtaaaatttaaattcaccaagcttatattttggtatagagttatgaaagtcattctttatatcagtatagtgtgggaagaaaatgaaaataaaaattctcagcgttgaatgaataaataacataatcattttaagcattacaacaattaatgaataaatgcacttattttttctatatttaatcaatatttattgagaacctattatacctattcctcttttataacaaatattgaacaagatagtcaatgttcatatacacagagtactttcagtctagtggagtgtgaacagacaaagaggagataagttcatactcacgtaatatttcattaagagctttaaaaatccttttgataatttccaagtcccaaacaaatactattacatagaggataaactcagtattaattttttcatattgaaatgcataactatctctatttttgtattgaaatatgtaaatattcaaatagacaactgaaagtgttatttcaggtagcatacatgagacagagctctcttaggagttgtattcgaatgtaaactttaaaaaggtgaaagtgtgtgtcttgtgaatatgtggtgatagaatgttaggatcagaaggaccatcgtgtgtgaaagccatgttgaaaagaggagagggccaatacaactttagggctgataatatagggacatcacctagaagatgacatgagagccactgtcaggtatagaccgggtcacataagggttttgaccatggcccaatcttagatttatgattcagcaaattacagctctgaggccaaagctggctcatgggctggtttaagtgacctatgagccaatattttattttttagatttttaaatgttcattaataaacatcaacaacaaagaaaaagaacatgtaacagagagaggctgtatgtgagccacaaagcttaaaatatttactttctggtcttcagaggagaaaaaaatatggtaattccagatggaaagtcatcacaatttgagagctggagagtcacataatatgtattatattttataatgactactttaatattagtgttgaaaatattctgcaggcagtcaagagcagaagcagaatgatccgttaggacgctatggcaatggtccaggcagtaggtgggaatggctaggtctagggtggtagttttggaggagctgaaaatttacaggacttgggctataactagaaggtaaaatcaatagaatttgctaatttggtgaatgaagataagcaaacagtttaaaacatgtgcaactgctcactgtgtggtgtttttctaggaagtgacaacccagagtgtgcacattttatatcgtgtttatgttacagataatttatttatttcttctagaattaaactccttttaccaattctatataattttctcacgctttctatttttttttaagacaataatctgtgatggcaaatgaatgctaacaaaagtaatagttaaaagagtcactctatttcttaaatatcattattttatatatttccattttgatcatcagttactttttctggcatcaaatttcaaaataacagcttaggagtggcagatgtattttgttaaagacagaaagtaatgccgtcatattcactttaaatatgttttgtcatttaacagaccctcactctttctctactggagttaagaaactatttttgttaatttgcttaagtaacctataagtgtttttccattttgcacagctcatctaaaatgatcatttttccagttattttagttgccataagacaatttccaaacttttacagtatcctttttttaaaaaaaataaagttatggtcctttaaattctcactttcttaaaaatctcaatagcctttgctattttatcttatttttacatacatgtgtatatatacatatatgtaaactaatttcttattatttcaatgtaaatatttccccagaattgttgtaccacattacattcaactatttgcttcctgaagaacttttaatttggcccaaatttctaaaattttagaaacagttacatggaacttatcagggatatttcatcaaaatcaacaattaaaaaaataaaaaagagaaaaataattattcatatcagatgagcttttcatattattgctgagtgtaggttacctttgtagtagtaaactgatcatcaaaaaattacctttaaaaatgattttactgttctgatactctttcctactgtgtttcatggctacacaaggagcatggatgagcaacaagggcgctccaattctgttcctctcaagaagggttacatattttgactgaattagctagttagttgtaaaaaacgattttactattgccttccaaatttagcattcatttgcctagactgtgcaaatctaaaaaaattgacaataggaattttcatctgctttagctctcttggaatttaagtcaatatttcagatcatgtaaagatttttttaaatgtatgttcaacaatctgtctgcccaatgaaaatccttctctctttcatcatttgctatttaaatactgaaaatcaaaccatttcttgctatagagataattaaataacctcatgtttttgtgactaaagttagaccagctgatacaaaatgttagattctacagaactctagggattgtattcacactctccagaacttgattttgttttgaggtgagcagaacttctataagctttatgtttaagaactttgttttacataaactatattcaaatctcaactctacaacttactcctattagctctctttatatctcagagcatgagtttctttttctttttttgcaataaaggattttaacacttctgagaagtttttactgaaataatgattgtagactaataataaatgttgacaaaaattggggtaaatggagttcttatacattaatgaatggagctgtcacttggttcaaatacttagaaaaatttttatggtattcactagagctaagcatttccctatcccatgacccagaaattattaatacaatatgcatgatacgggcacacaagaaatggagtgcatatgtccatccaaagaatgttcatagcagcttgattcctgatacataaaatggaaaattatccaagtactcttcagtaagaatgtgggaaacaaatcatggtctctctaaacctgcatgaaatgaaagagctacagatacacaaagcataaatgaatctcatagtctctatgtcaagcaaaagaatccagatacatgataatacatacttcatgattttatttgtatgaaattcaagaacagacaaaactaatttatggcaatgacagtcagaatagtgttacatattggagtgtcatattggctctgaagttattaaaaaaaaaacttctgctgtcatagaaactttaatatattgatcccagtagtgtttattggagtgcacacatgcacaataatttatccaggggtatatatatgaaaatccagcaaattgtcaaggaaaagcaagcattttattgtatgtaagttatgattaaataagaagttatataaagcagtttgaacggtatctgacaaataatgtgcaaacatattcaggagaacattagctataggtcaaaataagtgttatttaaaacccttacataccaattcccaattacatttagataaaagtgaacataaactggtcacaaaaatactgtttaataataatttaataattgaccaagtgttctctaaattacacattataaacagatgtttagaataccaactgcacatcaataaaatattacacaatttaatttagatggtaggaaatatatgcatattgaaacaatgtttaggagattttagagaaaaataatttaccatccatctgtgaaactggtaagatgcttaatggaactctcatttagtgcacaaaacataagatttgacatggtagatataataggcattactctttataaaagagttgatccacttttaaaatcaaaccaaattcattatttttttttgacattaacagaaatgaaggtcagatgcagtctgttgtatttaatatattatttgataaacttattttgacagatgtcttatacaatattccttctccaggaaaaaatatttggggttttttaagagttaaagtaatattgttttgcattttcagccagattttattagcaattagctggtgaatataacaaaaatatggattttttttggttggataccatcttgtattaaacatcatagagataagagactctgattttcagtccctattgaatctttattatagcttaagatttttttttatttttgtgacatatcctgttagttctaagtaaaagcactcagcatgactaggatcactttttatctacttttctatcagcagtttttcaggtacagcatagttacctatattattcacttacatgtcacttatcttcaggagctaatctgctacaattaccaagaaatgtaagatcctaagtatctcaacatatcttttgtttttatcttttctagcataattttgttattttatgtgacatttacacttgtctcaggaatgcaagattaggaaactaagtgatatgactaaaggtgcacctggtttgctatcagatctaaattcaaatctagaggtatggcttactcatgtaaaattatttaatctcttttaacatgggaattataactacattacaagatgtttgcaacaataaagatgaaatcacgtgactaattattgttccataatcagttgataagtggcacttaattttatgaaggttcatttcttacactgacttgaaaccccagcaaacccaagaagtgacccacttatctagtcaatggccaactattgttttcagtagcccaaacatttgggattttcacctttcactgtaactttcccaaacaattttcatgagattcatacggcactttttttctttcttgttctcagcctctcaaagcatgacactgtgtttgaacaagatagcaaaccactgcaaatcccgtttgtctgaactgctaaaaaaaattagttaaaaaatagacgttgtcacacttttcagacaagaaaatgtttagctattccattgtcagtgtaagataataatatcacactaaaataaagggacttttttttcttaatttccatagcctatggatattcatttcaatatctgagaaagcaatgacaaggcaatgtggaacaggcactccacttcattagctagttcatcccactctgaatatctaagtttaagtgccaatttcttcagagacaggatgaaatttgtaaattttatttcctctgtctcttccataaccaaaaccactggggggttatatacagtgccattctccagatggcttatgttatgagactatttataaaagaaagattgatgtttggcaggaaaaaaaataaaatggtcctacagtgacctagaagacaaaatatgccctatactcccatataaaaaagttatttctctctctgaatagatattccacacggaggaaaccgactcagaatgtttcacagcagcatgagttattttctgggtcacttctttttttttaatacttttcctgcctttgataaagtttcctttgcaatgttttggatattgaaatctgggagtttcaaagactaatcccaaggaatcacattatagcaaataattaatcttgatattggcaatttcctgacctacatattaagctattgcttatttcactaaacatttttcttcattaaaggcaaaggaaataaattctgagtttcatagatgaaagaatctctctctctctctctctctatatatatatatacatatagatacatgcacaaagacacatagacatatgtacatgcatacatgtacatacatacatatatatgaatacctgcacacacttatatgtataatgtattttatgagtttatatgtatatacatatataatctgtttattgtaacatgtgaattaaaatatagagaaaaaatagatataaaatatgcctgcataggtagatttcctttcctatcctttcaaaatggcttttttttttttttttgataattgcaagatactttaaaaaagatgaagtaaattttgcctgggaggataaatacttaaaaatttacttgctactttgtgtaagagacactgtcctcaacctggacatactgctctttgtacactgtagtgtgtaattttgatgtgtcatgcaggaatttttcccctcacgagttatgtcagaaattctagggtggcttacgatattggagatattcaatattcattatagcaagcaccaattaaagaagaacagaatataatctagaaaagcaatttcaatatgaaactgtaacacaatatgttcatttaccttgattatatttagatttcaagccagctgttgtatcataaacactgtttgtttcattgccaaaattaatgtgcctagtctgagttatttagaaaaatacatatgcaattatgttaaaattaaagaagttatgaaatatgattattaatcaaaatgctttacattgatttaaaacaagataatgcatttataaaatgagttctactgcatcccctcttcaggttaatagtttgagagttcatcattttttatttttctcagaagaaaataaatgtaaatggtttaaattcaaatttaataattcaataaattaaattctcatatgctaagttacatttaatccatgaataatgatagtttttcaacttatgtgtgtttttaactttatcatgcatttagtactggagatatttgtcttaaatattcatgatgagttaaataactttttgtgtacatggaagttcaaagagccaatttttgtactttcttctttcaattatattatatatatcccagaggttaatatagacatattgagagtagtgttgcagcttgatacacaattaggtaaactatgggtcccttaaataatgataaagccataatccaataatcctgatgctaaaacataatttactgaataatactaatattagcttatatttgctgcatgtatgcttccagtgcaccaagtacagtgctaagttatacacaaaacacacacactcatatttatatgtcagagtaaatttataatcttgatattattattctcaccatcttacatattcagaaaatgaattttggaggcattcaaaatcctggcatgttggtcaagaacttacatttgcagagcattgatcttaactgtgatgttatagtgattcattgtctttctttctttcttaaaccattacattacaatttccccttggtgtaaataacagcccttttctctcttcatcattcttttatctcaaagaaagagtatgacaggtatgttaaaaactattgtctatgtgtctcttattgtataccaagctgtttgaagtagttaacgtaataaattcatttaattccaataccaatgttacaggagatgaaccatttcaattttttagagataaagaaacagaggcatcaacagaataaaactttccttaaattgcaaagcccaatggtgatagagtcatgaaatatgaacccagtttgtcttgctccaaaatctgtgttttcagtcatcactgtgctttcattcaaagcaaggatacttgctctttcaagtagattatcattttatgcttattattattgtaatggaggaataagacatatacccaggaaaaataactagcaatataactagacatatacccaggaaatatatactagacatataccaaataactagacatatacccagtaaaaataattagcaatataagccgaacgtgatgagcgactatatatagtatgaatgagaagcactactgtaatttagaagtaaaaaaaaaaaatcaattatttccccactttagcttcctaatagcctttgtctcaccttctctatatgtttatatacaattcaacatatgttaaaaatgttatagcaattcatgctaccttttaacttactgaatttcagtcattcgctctgctttgcctagcagtagccaaattacacacacaagacatggaagaagaaaatttttttttttttttttggagacggagtcttgctctgtggcccaggctggagtgcactggtgggatctcggctcactgcaacctctgcctcccgagttcgagctattcacctgcctcagtctcctgagtagctgggattacaggcatcagccaccacgcctggctaacttttgtatttttagtagagacgggatttcaccatattggtcaggctgctctcgaattcctgactcaagtggtctcccagcttcggcctcccaaagtgctgggattacaggcatgagccactgcgcccggccagaaatttcattttagcttatgttagaaatgtagtagaagccgggcgctgtgattcacgcctgtaatcccatcactttgggaagccgaggcaggtggatcacgaggtcaggagttcaagatcagcctggccaagatggtgaaaccctatttctactaaaaatacaaaaaaaaaaaaaaaaaaaattaggcgggcatggtggtgggtgcctataatcccagctactccggaggctgaggcagagaatttcttaaacccggaaggcggaggatgtagtgagctgagattgcgccactgcactccagcctgggtgacagagggaaactccatctaaaaaaaaaaaaaaaaaaagtagtaaaggagacatgcgtgatagatttaaacaaaatgtatatctaataatataactatcaaataaagtatttctgtgataaaatttattgtggaaatattcatgaatgtcatagatgagatttgctttttcattgttttattaaacatctgtgcttccattttgaaataatacttgaaatcccactgtttatcttactttcctttgtcagtcataatctttgaaaatatgtagtgcaagtgctgaactgcatccacactagttctttcctaattaagagttgcagcatatcactgaaacaaaagaaaaatatttttattttttcaggtccttaaattatctatagctttagacactattgaccaattgtcagtgaatcagaatctccttccttactgttcttaatgactttgtacagtttgtatctcattctgaagtataatggctacttttactttcttaattttcctcacctctgcttagtgtgatagccagtttggatattcattgcctattacgacctcctacacaagtttattccatttttttccatcatcccagtcatgtaccattcacactgtagttatctgagtaggtaacatagtattacctcaaaaataaacatattaaaatgtaatttatctttttctttcaactgtctttcccatgaagttgacaccacttacctttcaatggctttatattctgaactcatcctgctagatcttgttttaaatgtaagccctattatctctttcaatagagctctcaattatttcttctttctttatgtctaatgccttcaagttagttcatggcctaatgaattctctctgaattatcctaacagcttcctggatataatcacaggtacaatataaggacatacaacaaacataaggacataaagccagagcacacacaatctctaattataaacttcaaggataaatgtaattaaatcacatgctattaaaagtattaaagtaaaagtatttcattaatggtaatcgcttggcacttctctaagccagatacatttagtccttaagaaaaatactatttatgtaaagaaaaattttccatacggacgagttttgtctttccaaaacacatttttttcagtcttactcacgatgaattatttaaattatgacaatgcttttgtagaataattgtgagatgagcgagaatagctactctaactttttaaacatttacaaaaaaatactgtgccatggttatattggagaaagaatttttaaaaattatcacctctacccaagtaattatataatcctattgtatatctttgtatttgaaactgtaatccttttgtcaccatttttttaaatagttacttaaaatgctcaccacttctttttactaggtgagccacctagttatgtaaaataaacaagtacttctcagaggccagattgaaacaattttatttagcttaaattcttcctagctacctactttcttcctttcaaaactcttattttcaaaaagatattaagataccagcactattcatttatatcacattgattatgtaaataaattgaaaacgtttccttacaaattaaaagagaaaaaagtaacttgcaataaccctgatatttttatctctatttattcaataaacagcatctttttgctctaaaacacacttttgaatacttgcagaaggaaatccagattttgattaaattttctattgattgctatgcaattctgtatgaatcatggttccttaataattccactataagtttcagattgaataagatggttgtcgatagacttggacttcaacactgtagctttatataagtcatttgaaccttcagattcttaaaaatgccataatgtcagtataacacaataattttttgattctgggtcaccaaacaaaatgttcataaaaagtcattcatccagtgttagtggctacataatagaagcaggtggaaataacaaatattttttatcatccacttctacacatcctcctggttcagggcctaaatagcaagtgtttattcctggtaagtacattatcttcttgaaatgatatattttgcttttaagtggtattacagtgagctagaagttataatacattcccattatgcatctaatatttatttgaatgtacccattgataagataccatacttatatatcaatgtttcataattctttaaaatggatggatataaagattaagatacatttaaagataacaaatcaatattagtgaagttattttgttaaggctgaatataatgtgctgaatattcagacatctacataaaagggaaatctgtggttctgtgttctgcctcaggaggtagaaaaaggatggatagatatagatagatagtgaatggtaagaaatcaatggaccaaacaacgatctgcaaatcatggttggttatgaagtgtcttgcaagtaatatgttcttcttcactgttaaggtagctgataattttttgcagttgctcttcaataaaccactattattcactctcagtttaagtagttctactgagtagaatttacgttgcagcttgatatggtttggctctgtgtctctacccaaatttcatgttgaattttaatccccacgtattggaggagtggcctgataggtggtgactgaattcagggggcggacttcccccttgctgttcttgtgacagtaaatgaattcttatgaaatctggttgctttaaaagtgctgttttaaaagtgctcatgagatctggtgtttaaaagctgcttttaaaaaataagttatttatttattttattattttttgagacggagtctcgccctgtcgcccaagctggagagcagtggcgcgataacagctcactgcaagctccgcctcctgggttcacgccattcccctgcctcagcctcccgaatagctgggactacaaggcacccgccaccacgcccagctaattttttttttttttgtatttttagtagagatggggtttcaccgtggtctcgatctcctgacctccgcatctgcccgcctcggcatcccaaagtactgggattacaggcgtgagccaccacacccagccaaaagctgcttgttaaaaagtactgtgtagtgcttccccctttgctctccctctctcctgctctgtcattgtaagttgtgcttgcttcccctttgccttcgccatgactaagtttcctgagacttcccagccacgcttcctgtacagcctgcagaactgtgaatcaattaaacctcttttcttcataaattacccaatctcaggtagttatttatagcagtgtgggaatgatcacagaaaattggtactaggagtggggcattgctataaagatgcctgaaaaggtggaagcaacttttggaactgtgtaatgggcagaggttggcatagctggggggctcagaagaagacagggaaatgagagaaagtttggaacttcctaaagacttgttgaatggttatgaacaaaatgctgatagtgatatggacaataaagtccaggctaaggtggtctcagatggagatgaaaaagttattgggaaacggagcaaagatcactcttgctatgctttagcaaagagattggtggcattgtgcccctgatctagagatctgcagaactttgaacttaagagagatgatttagggtatctggcagaagaaatttctaagcagcaaggcattcaatatgtggcctggttgcttataaaagccaatgctcatttaaataagtaaaaacaacttatatttaaaagggaatgagatcataaaagtttggaaaatttgcagcctgaccacgtggaagaaaaaaaaaatttctggggagaaattcaagcccactgcagaaatttatataagtaaagaagagcagaatataaatagccaagacaatggggaaaatgcctccagggcatttcagggacctttgtggcagcccctcccatcacagacctggggacctaggagagaaaatggtttcatggtccaggcccagggacttgctgctctttgcagcctcaggacatagcaccctgcatcccagctgctctagctccagccgtggctgaaaggtcccaaggtacagctcaggccattgcaccagggggtgcaagccctaagccttagtggcttccacatggtgttgggccttcgggtgcacagaaagcaagaattaaggtttggtagcctccacctagatttcagaggatgtatggaaatgcctcgatgttcaggcagaagtccattgcaggggtggagccttcatggagaacctctactagagcagtgtggaggggaatgtggggttcgtgtctctacacattgtccccactggggaactggcttgtggacctgtaagaagagggctaccatcctctagactcagaatggtagatccactgccagcttgcactgtacactttgaaaagacacaggcactcaacactagctcatgaaaacattcatggggaatgtaccctgcaaagcaacatggaaggagctgtccaaggccttgggggcccgtcctttgcatcagtgtggcctagatgtaagacatgaagtcaaatgagattattttggagctttacaatttagtgactgccctgctgtgttttggacttgcaaggggcctgtagcctctttatttgggccaatttctcctgtctggaatggaatcatttacccaatgcctgtagcctcattgtatcatggaagtaagtaatttgaacttgtgttttattttacaggctcataggtggaagggaattgccttgtctcagatgagactttggacttggacttttgagttaatcctggaacgagttaagactctgggggacttttgggaaggcatgaatgtgttttgaaatgtaagaaagacatgagctttgggaggggccaggaacagaatgatatggtttgactctatttccccacccaaatctcatgttgaattgaaatttctagcgttgaaggaaagacctggtgggagttgactggattatgggggcagatttcctccttgctgttctgatgagagtgagttctcatgagatttggttgtttgaaagtgtgtagtgctctccacttcactctctctcctgcctcaccatgttaaggtatgtgggcttccccttccccttctgccatgattataagtttcctgaagcctccctgccatgcttcctgtaaagccagtgaaactgtgagacaattaaacctcttttcttcataaatcacccactctcaagtaattccttatagcaacatgaaaacagactaatacagaggtctagagattgattaatgacctaggtatgatatacttcatttcgtatccttagtatagtgactggttgagcaacaacacataacctgaggccaaacaatgagttccttagaaaacgaaagatttcaggaaattattactctttctgctaagcagctacactgatagaatataaggctggaaatatcagaagctacttttgtcacacaaggtaaagaagacctccatactccctaaaaatgaagtcactggggtcacgcagagcctgaagatgaataaatcacataataagatgatctgaatcattaattcaagccatgcaagaaccagccttactcctgtttcagttatgcatactagtttaagttgtgtttctgttacttgcaattgaggggggaaaaaacccaaaatgtaggagaaaatattgctaatgatttattatataagcaccttaaattatgtcaattgcatcattattgtcatttacttcttcccctaatgacttgtacactggatgagaatgtagaatttaaggtcttccaggaacacctatgaaagactgaaattgttgtggatgctttggcagaaagatatcaaggacttttgctctgatgtagtggttgtctactgctggtccacatactattgatgttcattgatgacattccactgatacgtgaaaacgtgggaaaatagattatcagatgagttattcacaaagtcaaatgcattcacttggaagagctccctttccttctcagattatgacttctaagcttttttggtggaatactgctttttcttttttaaatgaaataatacctttaataaataggtttgtttgtctactttacaatgtgcttttttaaaattttgcataataaaaggccagtttttctgtgctgcactttcaaagaatttaaagtttttcattttttccccctaggtttagaaaattctgggataaactgcttgtagtaatttccttgaaagtgtttatggtatcacagctgtcactagagattttaaccaaccatctgaagtgaattattctctaaagataatgctgagagactagtattaagccatttgctgaattaaagatagaaaaattttgaacggatgaaagctaccaatgtatggagcttctgaaagccatgattaccaggggctgctgtggcttctgtagtgttattggaaacttcatctacgcagagccagtataaatgacctccaagatggcgagtcaaaaagcagccacggggaaatacttttgccaggatttgtagctgctagggtagagacagcaaataaaagacatgcttttctcccttccatcacccatggcagatatagctaattttaaaccatgtgttgtgcaaagatgaatactacttcccattataggcctaaagataatatagtgctccagttacaaggtatgtgcctttctgcttcaaacacactgtttatacatttctctgtgatgctggagcggaacactgcaaaccacatttctattcattaattgcctccacctattgaagaaaggaggtagggggagaaggcaagtttgaaagagacaaatggacactctccttgtttgcgttcatttcttgtccatgtcactctacttgatgtggtttggctctgtgtccccacccaaactttatcttgaatagtaatccccccgtgtcaagggagggacctagtgggatatgaagaaatcatgggtttcccccatgccgtttacatgatagtgagttctcacaagatctgatggttttataagtgtttggaagttcctgcttcgctattctctctcctgcctgctgtgaagaaggtgcttgctttctcttccacttccaccataattgtgtgagtttcctaaggcctcccaggccatctggaactgtgagtcaattaaatctctttccttcataaatcatccagtcttgggtattttatagcagtgtgaaaacacatacttaacaatgcttctagttccttacaataccatcaattcaatctcattaagagttttacagataaaaatcagtcttatcatgcccctctgagataccagcgccagcatgccctagtgccctcctgaaaggcttggactctagctcctcctggactcttcttggttctgagaaatatcaaacagtgtcctttttcaaagggatgagtgtcagctctgtagggcttctcttttacacttctaattccataaattctacaacttccatttgttttctcagccttaaggatagtagctgatttctggattattattattattactattattataacaatattatgagttctgatatctcagaagtgtattaatctctcatatcttacatatatatttaatcctcacaataatgctacgtggagagtcctattattacccatatttttaaagataaaggaaatgaaacagaaaatacgatatttgacttgcctgtggtgagatgtgagtcatcagaagccgacattaggaacagcagtggggaatgttaaaaaaggaaggcttccttgctcagaaatcactagacttttctgtcatctcagaataatcctctggtataaacaactgtgggtcagagaggggccatggtagttggctagtagtaatcctttaaatatctttctcattaaatagagataaatattttcccaagaagactaagtagattggacatttccaaaactttggaaagattcctaatatccactggagagcatagcctgggataaagatgatttctacctctattgtaccaaatttttaaaaagtgttctactcaattatggccacctgtttctaccccaaatttctcctttctaaagtgctgtgttatttactgtgattctaagagatttggtggttaaaatgcaatacatttcagctgggcttggtggtgcatgcctgtaatcccagcaatttgggaggctgaggcaggtggattgcatgagtccaggagtttgagatcagcctgtgcaacatagtgagatcctgtctctatttttatttaaaaaattaatttataaacattatatatagtgcatttattatatatcatatacttatattttataatgtaatatattaaatgtgtaatttaaatatttaatatatttaaaggattttatactaatatatttattttacatatttaatatactcaagggttttaaatatttaatatattcaaggaagacttttaaatatttaatatattgaaggaagtgtttaatgtattgaattttatgtatatatacacatatatacatatacaaatatacacatttgtttacatatacacacatgtatatatatacatatgtacgtgtatatatacatataatgcaatacattaaatataaaactcttccttgaatctcagcatagttattggtagtttggaagtgcttatgccattaccatttataaatgcagtgctaatatcttcatttcaattatccttagaaaaggctactataccttgtccatataaaatcttattgatcaaatattaccaaggagcatgatctgctaaaggtctataagacccagttaaatggctccagaaaatctaaatttgcaaaggctggagagatcttaacttcagagagaaaattgagtcaggaatgcacaacttttgtggactccaacatacactgcaaacagtcactggtatcttttaatagtatgaaaataaaaaatctttatcaaggactcagactgtcatagctatcattctaagtatgaatcatgtttaattttttacaacagttctacgtggtgagtactattatatccacattttacatactaagaaaactcaaatttaaaactatctgagacccacacagttatattattttttcaaataacaatgcttggattaaatctattaaataatttttagaattataatgccaacagatttttctacacaaatttggcttttttctgttttgtaaatatttgtttgttctctggaagttggttgaataaacaggctcctcagatatcctcagatcttacttccaagcaagccaactatttatatgcaattataagaagtatagtttcaagaattagtatgatagagaagtgataaaaataaaagaaatattaaaataaaccacttacgtaagttacaataaattccaattaactcagtatgaaatattattttgcaaagcttatttaataaattattacagatatctatgataatataaacctaaagtatttagaattctcaattaaagcaattataaggcatccctctggaaatcggtctacttattcctggaaaacagatttctacaagaatctggactcagtaataacaatgatagcaacatatgtaggacatataattatgtatttttactgagaatctaataggagatctaatatatatatgtgtgtgttcatatatacttacatatattttcaaatataatattagttaatagtctgttgaaatatttgatacactacaatttttatataatccaataatgaatgcaagaaacaagcaaaattttaaacatatttttgaggacattaggtatattattgctttcaaaatttgtcaagattcgtaatattactgataagatacaggattctttccttcctgtttaattgcttaccacccccaccctcaacacacacacataagaaagcatattgcatgtattttggtgtttttaccttccgtattagccgttttcacgctgctgataaagatataactgggactgggcaatttacaaaagaaagaggtttattgaacttacggttccacatggctggggaggcctcacagtcatcgcagaaggcaaggaggagcaagtcatatcttacgttgatggcagcaggcaaagagagagcttatgcagagacccctgttcttaaaactatcagatctggtgagatccattcactatcacgagaacagcatgagaaagacccacccccaagattcaatgatctcccactggttccttcccacaacacgtgggaagtatgggagctacaatatgcgatttgggtggggacacagggccaaaccatatcaccttcgtaattttgagatgacacattatacaaccctcctaaaacttgtaggaaggcttatgatgaaaaacagaaacaaaacagatcaaaaggaaatactgatattgcaaattgcttggcagtttttgtttgtttttcagatttcagcactccaaatctggaaaacttaaaaatgtatgtatttaatttaaatgtcaagttgtgatctagcttttgcttggatggagtgataaaagatcactacttttccaagtctctttcccataagtcaggtatggtgcactccacagacactgatggcaaatgccatcatctggaaggctaattttaaccagaaaagtctgggttagtagttttctctcagcttgtctttagttagttacttaacttgagtttcagtgcaggcttgggactaaagtaaaaagaattttgtgggtttgaggtcagactatgtgaactattgattctttctcttcacaattaacatcacataatgctataattaatataagtgcatttaaaacttagactacaactttagacacattttggagcagtctgttttcctattcaagttggtaatatctacatttaaatacttatatcacatattaaataatgaaatatcattctgatgttgtttgaaaatcagaggtctttaaatatctgagtacttaaatatggaatcaaagttattgcctgaataaataattttgaaattttggaaaataggaaattaagctaaaagtagatagatatgatgaatgatttttgacctcttaaataaatctcataaatgtgaatttttatactaatttgtggacttttttgatagagttagtcgggttcagatctctctatattgatctctctttctctttctctttgtttctctctatatatatcagaatacgcataatattttctctcacacccttctaacccaagaatcaagtaataatcatcaaattaagcacctcagagactctttgccatcagaagtcgggagtaattacttctctgaaaaactttgttatttattaaatagtaatttagcacttacaacatgatgaatttgcttaatcattttttgatatagcaggaataagacatatatattccatatcaatatggaacttgtatgccatatgttgagacacatacaatttagtagtatggttttacattacactctcccctaaatctcagtctgccctaaacctcaagagtattccctaaacctcagaagactgaagcgtatttgcctaaattagtagttgtcaggcccgagtaaccactatgcatttcacattgctaagaatggctccgttatttagccagtcaagcctagaaactctgaatttgttgtggcccaagtagtcttaatgccgaatttctgatagactgattgattgactaccaagttctctttcaaattactaaagtcattaagggcaccaaattaaaacatagctaagcatttttctactcagatagttataatcagtgggaagatattttttcttgttttttttgaaaataaaataggttcaaattaatacatacaggctggatgccatggcttacgcctgtagtcccagcacttgggaggctgaggcgggcatatcacctgaggtcaggagttcaagaccagcctggacaacatggtgaaacccgtctttattaaaaatacaaaaaaattagctgggcgtggtggcacacacctgtaattctagctacttgtgaggctgagtcaggagaatcacttgaacctggaaggcagaggttgcagtgaggcgaggctgcaccactgtactccagcctaggtgacagagtgacagtctatctcaaaaaacaaacaaacaaacaaaaaattaatagatacagatatatatttttaactcatgggatttattgtaatgaatgaataaaagatgcttgaatattctataatttcacagtattcttttgcttactttcttggcagagatgtaaaaacatattgattatatagagtagatacttattttgtagaaataaaagtgtatggagaaatctttgcagatgtatttatcaatataaatggaagaacatttgttgcccactaaataaataaatattggagatatttccatacaagtgttctgcttatcaaaagaaaacaaaatcaaaacgcttgttccatcctttgttgccctttagctgccactgtgttatctccacaagtatgatcttgtaaagagtcatctctggattcaaactttttccactcaactctcattcttctcataccacaacctgcttcccacctctcacattcacctccccccacatactctaaacttagtaatttcaataaccttctatgtctttgctttcaacttgctcatatttctccaacattttccaggtaattctcaattttagaatatcttttcccaatattgggaaaaagagggaaaagatattctaaaattcccttctcacttatatagatgtaggactccttagccaggaatactgctactcctttatcaaatcatacactttttttgtctgccggcttttcacatatttgctcctattcaaatttcctttcctacatacccctgggatgccttccatgattatgaagtaggtgcttaaggaagcttgacaaaatgaattgtttaaaacctattatttagttatttaacaatattgttgacaagttactatataccatgcactattttaggtactatgaaggaaacaacatacatgctcccttatatcaaggagatacagtatacttgggcaagtaaaaggaaataatgaactaaattaaaattacaactgtaataagcactatggagatgggaaatagtaacatgggtccatttataacacaaatatctgttatattctgggggactgaaggttttcttaaggaagtgacatttgaactgagatagaaacaaatcatataaacaggataaaaaagaaaagcgtcaagtgagaagactgttaaatgatgatgaatttacacaggcaaagaaagaccttgtaacatgatacattcaaggcactgaaacaacagagtggaggctggtggaatgtgtaaaggagatggagacaggattgtggcttctgtagaagtggcttgaactgagatgatgcagaaccttaaaaactgtcttttattctaagagcaatgaaaagacatcagatgattctgaagagagagatgacttgaaaatatgtactttaaatccatcactctaacatatttgtgaacaatggagagtaggactcaaggacagatacaaggagacaagtaaggaggctattgtactggtctatggtaaaggacgatgtgagcacaagtgaaggtgatggatgaggacgtgaggaaaagtggacaaattaaagataatggaggggtgggataaaaactgtcataacttagtattggtttggacatatgaaaatgagggaggaaataatccaggaccactcctgggtattttgtttgtgcagtggatgaataaatgattctattcattgatatacataatggtggaaaagaactagactaatagaattgagagttgagaaggggcatgggagagattataaattatgttttttaaataacatgagttttagtgtttgagattaattagtgaaaataccaatttagtatctggatataagcactatgctcaaaaaagcgatccatgctaaagatttgtatgtgtgattcatgcatatgttgttggtagtaaaatcatggatcagatatcctagaaaataaggagacagaggaggaacaagtgaaaagattctagaactaagccttgaagaaattcaagtttaatatgatagaagaatgagtgtgcaagaaattaagaaagaacagcctaagaactatgagaagaaccaggaaagctatcatagaagccaaaaaagaggggttttgggaagaggcataaatttcaaaagcttaaaaatgaagaaaaaaacacaaggaaaatgagatccagaaaaaaaatcaattgagataaatgaatgtaattactaatccaattaaaatttatagtgttacagcagatgatgccacattatactatagaggacagagtcatggggccacgaataacagaaaattaaacctaacagcaaaaacaatcttataatctagaagttaagtcacttatgaagtttttaaccccagaaaatagtagataaataaaagtaaaatgaatacatatgttaatttttttgaagaaaagatcactgaagtatttgaggaaagtataagagaccacaacatttaaaacataatttgaagaacatagacaatagcaaaggaagcatagacatctggtagaaacgaccaacacatgatatcagaactaatggggaaatggtgtagttgaagcatggaggaattttgcggggggaaaaaaaagctaattgaatttggctctcacgatttttttttcttttttcttttctttttttttttttttttttttttttttttttgacggaatctcgctctgtcgccaggctggagtgtagtggcgcgatctcggctcactgcaatctctgcctcccgtgttcaagtgattctcctgcctcagattccctagtagctgggactacagccgcgcaccaccacgcccagctaatttttgtatttttaatagagatgggatttcaccatgttggccggatggtcttgatctctttacctcgtgatacgcccgcctcggcctcccaaaatgctgggattacaggcgtgaaccaccgtgtccggtctgatgattcttttaataactgactgtaaatatagagtccctctccctgtaacccccttgaaacgtttttgatttatcagcagataactaatcagaacatattgatgtttttaagaagattcctcagggcagcttgaatggagggaacagagactagcatcagcccagctagccttagaaatggcagggtcaaggtaatgaagatgtgatgaaggcagtggtaacaagaatgagaccaaaggggaaagtgggagacagcttgaaggagaaaatggaagtcctctgtaaataactggataacatggatgataggttaatattataaaggatgccatatttcaagtgaatagaatgccccaccaatacagaaatggaatttagaaaaaagccagtaaatagccaatgtataattgattagcaactgagtgttaaaacataatgctttttctaataagagcttaaattctgttgaaatgtaatcatttgcatttccaatgataaaacacacaaggaaagctagtaaacaattcatttggaaaatataaacatttagggaaaaagaaattcacatagagctatcaaactagtgttaagtgcttggctaacagttcaatactgattacttttcctctctctctacccaaatattgcttctgaatatatgaccttgaatatatttgcaaaggatgattgatatttctaaatagcattaagtgaagttattttccactcaaagaccaaatattaacattttcagattaaaattataaaccaagaagccaataaagcgggcagacactaaatatatatagacaaattgacttaaagtgaacaaagaaagttactataatgagttaacccataaggaaaacctacgtatatgtaaaacctagaaattcggacttaagttatttatagaaatgatacagaaggtagaaagaaatcatttatgcagatattgaaggtaaaagagtccttggcagcttcccttttaacaaaaagcagccccccaaataaattcttttctaacaaagagcagcctgaaaaatttgagctgcaaacctagacaagcaagttggaagcttgcacggtggaatgccggcagctgtgccaatagaaaacagctacctgtgggccaggcatatccaacatggaggctccatcttcttttttgttgttaccacatgcacagtaaagaaatgggcaacatggtgcagctcaggcagaactgcataataaaagattaggttgagggaggccagaaatttgcaccctatgcaggtggcacatctagtcctaaccagtttttcacagcctatgcaaatgacacacctagtccaaccagtctttcctaccctgtgtagatgagacatcacctcttcaccagctcatctataaaagctgcttcattttactgcagatccagtaacccatttctccaggacccctctctgcagcatcagagagcaattctctttcttttgcctattaaacttccactcttaacctccctctttgtgtgtctgtgtccttgttctccttgactgtggctgtgggacaacgaaccttgggtgatactccagacaatgaaactgtttcagaaagagatccctataatcaggaatgataatttaaatagttaacaaggggaacttaacatcagtaacttactaaacagagcgcatgaactgagtgggaatgacagtcagggatgttcctgctctgtgaaagattaaatttgatgctagattccgggaagctctgggtcatgtgagtaggggtccataaaagtcagcagagtagcataagcctgaagttcttcaacaacaggttaagaaatactgcagttctttaatcataggcgggtctctaccacaatgtaccatctgaatgtcagcattggctatagtcctactttctattcaaaatctatcaaataatttttttcctaaaataaatttttttactttccaccttaaaggttatattattcagggaatagtttttagtaaattacagcatgtattcttattataaggtagaacagcagagctcaacattacctcaccaaagtgtccaagctagaaactttcttattcttcctaattccttctgttcaaacacataggcatataaagacatgattaaaatagcataatggttcttttactgaactgtgagtcgcaatttctggcgtagaaattaagtgtttgactcatcttttcattgtatcatctggcatggttttgggatcatagcagatatttagacaatgaaaatagatggttggattaaaatatgtgcatacataggcatgaggatggatggataaatcattatcatctattagtttcacgaatcttcatttacactacctaaatgaataacttcatagagctacttgggaagttctccccttgcagtttatggaagaagcttttccttgatcagataagtattatttccttgagtgtttggtagaacattcgattaaaacagttaccaggggtgtactttcatctaaacatttcaagtcaccaattcaattttgttaatgtttataatacctttcagattttctatgttaactttgagttcatttttataagttaaattttttacatttgtgttttttagtgtttacattttttggcataaatgtatcttatatttttaatcttttaaaaatcttaaatatatgttatatttatattaagtcctcttccctttctagtattgtttatttatgttttcttgttttcgccccatggtcaatttcacaaaaactttctcattcttcttaatgtttacaatacaaaaacttttagtttattgaacttctttattgcatttgttattttattatcttctatcataactatcactttcttctttcttatttcttccagcttattttgtttttcctttataatttgattagctttctatttaattcttaattttcagcatttttgcttccagtataaacattaaaaatcaaactgactttagctatattgcatgcattttgatatgtgatgttattatttcaattctaagcattacctagtttccattagaagctcttcttcaactcaaaattatttagaagtttattcctaaatatatgatattttatgttatcttgttattgatttctagcttaagtgcattgtgttcaaagaacatattctctatggtacttgtttttaaaaatatgttagaactggttttatcactttatatgtcatcaacttttataaaacagtacttggaaagcaaaggtgtgttttccagttgttaaatgcaccaattaatatacattgaatagttaaagcttttaaattatcttaagtccaaattttatatagccttatcatttttttattattattttcatagactaactactgagagaggtatgacaaagtttctacaatcatgatatatttatttatttctctctgcagttacattgttttttctttatgtatatggaaaattatgtatttagacacgcacaagtttaaatttttttttgtcctggtggaattagaacttttatcataatacatgaccattttatatccaaatttttttgtcttaaattccttgttatctggtatttattcttttttttttgtgggatgggaaagggttacattttcctggcatatatcttttaatctttatttcaaactttatgtttcatggactgtttttatttgttttttaagagatgggttcttgctacattgctcaggctgctctggaactcctgggctcaagagatcctcccaactcagtctccagagtagctgggaccaaaggtacataccactatgcttggctttagatgttgtaccctgtttaaccagtctgtagtactgactcatatatcatattgtttgcacatttcaatagcaaaccactgtaataaagactctctggccttctcactcctaaattctataatctgttttacagtgtaatggtagtgcttctggctatgctcaggtaagcttgaatttgagagagaactcttctacgaggtattacatatttattcactttaatgcactctttatttcttgttcatctgagtaagtaaaacatacattgtgaattcttatgtaggatttaagtagagtttgaagttgaaaaatatattaaagctaattggcccccaaagggctcaaatccatgatcttagactcattagctctgagcatctaagtaagacaaatacaacaatgaatccattatacagcaagaaaacaacattaaatattttaaaactttaacttgttgactttgaaaattgaagaaaggcagagatgcaactttctttttagtactgaattatttatccttcatatttgaattcaagtgataattcagtgtgtacttaggcctgatgtagttagcattggcaagtagttatgcatttgtacagtgggcagtattctgcatgtgagcacatacatgaatccagttaccttatcattatctttcacaattctacataaattattttacaatcccttattgtgattacattctttacttccctccttgttaatttagtactaagcaacttgtatgtaatgaaaacaacacaggtcacatgtgcaaaatttaagactgtattaggtagaggggaaaatgaaatattgcatcacttttttgccttatcaatgtaaattgataagtgttgtatgtatactactcaatggatactaataaattcttagctagggcttccatggcaggataattttcattagtacccaatgcagtgagcaattttatgaacatcatgtaatgtgtgagcatctgttttcatgttcttccaaaattaccttcagttgtctgtgattctagcagtagttcctcatatgttatagtcacagctgtttttctgtgtctcagagacatccaggatttctgaagttacaatcttgatgtgttatgacacaacacgaagcagtataatgcagtgcttgacagttgtatgggagtagagaaagcattaagaagagatattaagagcacagactctggcatttggtagctttgattccatttgcaggtctgttacttacatgtattatctagggcaaattaatgaatttatctgtgccaatttttccttacatgtaaaatatattaatgctcaccacctagaaaaaaaaatgaggaagcacatataaaagtccttggcatagaataggtgctcaacaaatgttagtttatattgcacatctagtttaattttgtccttatataaatcttctgatatatgttgaaagtcatatttgggtctgaaataactaaatgtgtggtggttacttaggaaaagtttcctagtttttctgttctactgatattttcaatttcaattattaaatatgttacagaattaataactttaattgtatctctttgttagaagtcaatttttaaataaaaatttacaaatacggtatacaccaatttatagctttggtaaagtgccaaaaagaagtggaggaatggaaagagacttgtcaaggagtacaaagttacagttacatagtagaaataagttctggtgttccatagcatagtatgatggctagggttaacaatatatcttttattacaaaatagctagaagacaggtttttaatgttctcatcacaaaaaaaatgataaatgtttaaggtgatggatatgctaattaccttgatttaataattataaaatttatatatgtattaaaacatgttgtactccataaatctgtacaattattatgtgtcaatcttgcactcaaaaaattttacctaagcctgttgtttttcctatgtgactaagacaaagcaatgtttgagaaatatagaagtctgttaggctgttttccgtcaggttgtcacatatcctcagagccttgatacctaatagacatttgtttttttctccatgtaagtaaagcttggtttatttgctaaatttatcctgctaaaacaaactctttctgtgaattctacaaaacacagagatgctaaactgagggtctcatgtttgcatacagtttggtattttggcatatgacttataatatgattggaacatacatgcaacatataaaagttcttcacagaagaatggtagggggtgggttcctgaacacagaacacaaagattcagctgaatgaacattggtaactgagaaataaacccctgtgatatatatgacactgtaaattgctgttaaagcaatgtttttggtcaactcgaaagaaatttgtgagacagttttctaatggttacttttatctcttactcaccgaaaacatatcaatagatagggaaaatattttcataaaatgcttttcaattttaaataaaaatggtagaaacaaattggtttttgccataataaaactctcaaaatattttctgttgctgagtgtacgttgcttggtcatatcaattcacaaatgctttaaaaaccttcgtatttttatgtttatattttctattttttatgttcactgttaaacgttttaaaaatgaaagattctattattctttcgcaaatgatacacatgaaatagagctcaaggatctgacatgctcacaattcatgtgctttaaaaataaatttccacaaagctattattgatcaagggacattatattcataatgctgaatcataatagaacagctttataaagcattactagctaatatacaacagaaattaatgaacacttgctaaagatgattacaagatacttctgttaaatgacacaaaagaaaaaaaaactgctagccatcacataaaacactgctatttttctttttgtacataaatacttagctaatcaaatggtattttatgtcttaatcaaggggtgaactgctggaaaaaaagaaaagaaatttcatgtttgtggaagggattctttttacttgttagtctaacagcttttttgtaaacataagaatcttactatgaagcacaaaatgtacagattttaaaaaatgctttctgtcatgatcagtatgcagtgccttaaaatcctgtcagtaggagcattcctctctttttaggaagagttctcctgacactttcttagccattgggttatttagaacaccaactatcctttccttgtattcagtatttctagtcctcacaataaccttttaaaataggcatgtgtgtttctattttgcacatgagaaagtgaaagctcagagcaatgaaatttattgttcccaatcacatggatagcaagaggatttgtgtttccagtacaatcttaacaaactccaaaggccacttctttcctccacaccacatttcctctctagtgaaatctatggagtacattgtatattaaatacagtagccacgagttaacgaaataataggaagcagatgaaaataatatagaatagaaaaaatggtgatatgaatgaggaaaagcaatggaaagaggagaggagagaagctagtggttcacattattattttttgccattgactctttttctggaaacagctcttgcctttggtctggagaacatccttccctgactcagcctagtagctttgggtaagctgattaaagtgcaagcaatacatgtggagcacttgatctacagttatgtcaatcacatacttcattcagtcatccttcgttgataggtaagccatcaaagcaagttaaaatcaatctgggaaaatcatgtgtttgttgagatcaatatttgcttttcctgatggatttggactgtaaggtgtggaaaactttgggcactttgctgagcctctctgaaaatggagctatctcaaatgagggggagctaagagataaagctctgtgaccccatttgacctcatttctgcctgcatctaaatcctcatctacactccggttcttcaattataagaattcttccactttttgtgtaaatcattttgtatttttcatatgtaaatgacagccaacatctatattttgttgatttctccatttatagctgggtttatataataaaatgaatatcattcacaggaaaatgagtctctgggaagcaacattctctcataattatcaagtgactttgttttaataatctctatgcttactgctccttctggtagaaatattgatgtgaggggccttagatcaaaattctttaggaggaaattttcactaatctcagtatgtttcaccctgtcagatatatcccagataaagcttcctcatgatcagtagaccataaataagtagggtcttctctatttctaacgtggctatacatcctgttgtgcttagggtcatgatcactatgtatgcctatttttctagtataattactgattgtgccttctttcatctcaaaatggttcccggttgcaagataaattctatacttatattattgctaacagtcccgatgcagcactgaatcattacaacattaaggatggctatatttttatttatggtcagatatatgtacctaaagttcatgatactttattattgcttttttcttgcatacatcgtatattggtactctcacttttttttcctgtggcaaaacttttaattaatatactgtttcagaatatcagaaacatatataataatataaattttcttatatatttaattttgaatcaaatgccttttaatattcaaatatgataaagtaaatggcagtgtcacaaaagttttaaggaaaatttatagcaataatttgagaagataacatttagttttttttaaagactaacattcattgttagatgcctccgtttccagctaacataatgtaattgtttaatgagtacatagcaaggaaaaataaggagctgaagaactaattgtttttcaaaacaatattggaggtgtttcacagaatgttaggcctagcgatcctgatatcagtcacacacacacacacacacacacacacacacagtgaatttcctaacatgttaggtcatcaataaatgttctatttataaactctccaatatctttaagggaccacatgctatggtagaccacatggatacctcctgtatcacatgagatatcagaaataaagccacaagttattattttatttctctattttcttggctaattaccctaaaacattcctagtttttatacttaaggccctatgtcttataaatcctctcagtcctaagtatattgatcaccctattggtgacttatcataatggtaccaaacattgcagtgtagtacatcaaggagttgtaccagcaaactctccctgatctgaaccaaacgagataacctgatgtttccatattttcttcttattttcaaagtgtaagtctcgctctttttttaaaacacatttttgacttatagaatttaattttatggcacgatacaggaatctaacttgtcatttaaaaaatagctaattgccctagaatcatccacagaaagatatacagtcatgtgtcagttaataaaaaggatgcattctgagaaatgcatttttaggcaatttccttgttgtacgaacattatagagtatacttacacaagcccaggtggtatagcctactatatacttaggctatgtggtaaagactatatttctcctaagctaaaaatctgtacagcatgttactatactaaatgttgtaagcaattacaacacaatggtaagtacgtacgtatctaaacttagaaaagatacagtgaaaaatatgatatcatgattctctgggggcatgatcatatacacaatctgttgttgacagaaacatcattatgtggcacataaatggatattttttcctatggatataaaaatcatatatatttgacactttgttgttgttaagttaggtaattaggtacacattttccattcagtgtttttttgttttttgttttctacagattcctcactgggctttatttttctaggtaaaatttataattagcttgtaaattataaaataaattccatctggtacgttcaagatgtttgtagcaatggcctcattcataatagttaaaacctggaaaccacccaaaggctcatcatcaggatatacattcatataatgtgatgcttttcagcaatgaaaagaatcaagtccctaatactcatgacaacatgaatggatcttaaaaatgtggagtgaaagaaagcagaaacagatagcacacacacacactcacacatacattgcacaatacatagtgtgtgtccaagaacaggcaaaattagtctatggtgacagaattcagaatgtggttgtctctggagtggaggtagggttacagaacagagacatgagcagtgatgtgctgttgaatgtctaggctttaaaatatggatatgtgtatataaatgtttattaaaaattttactgatataaaaatatgtagcaatatttacacataataaaatatacagtgctcttctttgtaaatttcatacagcctgtaaactgtttttgctgatgtttactgttctctggtatctgttgatattattgcaattcaaccatggctagacaaatagaatcgtgtcgctacctgttcatgtttgtcccagtaaatttattgtcattaaatctggtatttgacctactgtaaattaccacactctctcataagatacattcattaagctgaaatctcattcagctccagaattaatttcaagttaccagtgtgatgtttaactgaaggtggagttaagacaagatacacagtgacacatgtatgcacgtcctccatagaagtgtagtatatgtcaataaccttcacaccatagatatggtaaaatgtagaaaaacaattagaaatcaagaaatctagactatttcctttttaaaatgtttatttaatattgtttctataatttatttatttttatcattattttttttttttgaaatggagtctcactctgtcgcccaggctggagtgcagtggcttgatctcagctcactgcaacctccgcctcctgggttcacgccattctcctgcctcagcctctcgagtagctgggactacaggcacccgccaccacacccggctaatttttttttttttttgtatttttagtagagacggggtttcaccgtgttagccaggatggtctcgagctcctgaccttgtgatccacctgcctcggcctcccaaagtgctgggattacaggtgtgagccaccgcgcccagcctatataatttaatttttaattatttccctgtttaacaacatgcttgtgaaatgcctcaaatattaacaattgttcctgataagctagtactagctaatgtcaacctctctgcagtgatagtcatattctgtaacttgttttgaatagtagttatatgggtgtattccattatcaaaatgtattcagtttaacagacacaaaaatacatgtcaaactttgtgttagacttgcatttaatatatatcttttggaaaggtgagaggagaaacaacatctttaaaatattgattcttttcatccaggattatgatatgtctgtctttttatttttattaacgttgtaaaatggtatttttctttgttcattgtttattttctttttcttaacgtgccagctggagaactactaatgtataattatctttttatcctactgagttttctttataattttaagactccttggttgattccttgattctcttatctgccaggttgattgtcatctacaagtaatgataattttatatctttatacacacacacacacacacacatatatatatatatatatatatatatatatatatatatgtagttcctctctcttttatttgttttgggatattgttttcccatggtgatttaagtgagaaatgtcattctaaaatttgggcatcttgaattgagaccaaagcatgagttaatcctggatgaagcacaaattatagtgaaatcttttatctttgtccatagttattgataacaatttttttgattacatttctttacacattctttaaatctttcttaacagactgaatctcagtttaaaccagcatagtccccacagtgctttctgcaatgatgggaaggttttatacctgtgcagtccattaggttattcaatggccccatcaggcttgtgcacaaagtaaatgttgcttatgtgaccgaggtattaatattgagcataattttatttattttcatttaatttgtttaaatagccacaactggctaatagctactacattagataatgaagatttaaacacttgtatgtgccaagaggctattgccaataagttaaaagccccttggtcatagagcctccatagtaaatctacaactttaactacaataacctcagctttatctttctcactgcagcttttacatgcacctttttcaaggatacagtcaagatttttctttggtaattattttggtttgttttgtactccttgataacactgtaaacattctaatatctattttattcagaattcccaatgcctatgactatattgaaagagttgtaagaaacgtagtctcttttcctgcctcctggaaactgggctaaaatgctgacatcaactcatttggcaacttgatatataggaggtcctctttttccttttatgactacagatttggaaacatcttcataatagcacaatcaaaactctgccccctcattaaatttacacaagcaagttatcaacaaccaggccttgtcaatgaaagatcactatgaagccataaatgtgagtatacgatttattgtaaaaataagtaagcagtaatctgctaaactctggtctttaaaataaaggaagattttgccaaatatagatgggctgatttctaacaattgtaaattattaatccttgataaagtttcccctataattgaaaattttacctttcagtttaccgcacatagtactgaagcacataccctctataataatataagcaagcaaaacaaaatccataaataaacaaatacagctggaagtggtggctcacgcctgtaatcgcagcactttgggaggctaaggcaggtgaatcacttgagttcaggagtttgagaccagcctggacaacatggcgaagccctatttcagccccttgggaggctgaggcaaggagatcatttgagcccaggttgtggagcttgcagtgagccagattgcaccactgcactccagcctgagcaacagagtgagagcttgtctcaaacagaaacaaaaacaaaacaaaaaaacaaaaagtacaggtaaatgaatatggtcagaatctattttttacttcctgtatctatatcctttgcaatgtgacttcacaaatgttccctcaaaaggtgacatctgttttcttctctccttgcataagggctgtctttgactaggtggtagaggcagacaggaagtgagctagttctgagtctgtgctttaagggtccttgtgtgcttttgcttgacttcttagaattctgctcagccacaatgtgaagaaatccaggcgaccctgctccttacatgaagcagagatcagtcatttcaaagctgaggtcgctctagaccaactaaccttagctgatccaacagcagatagatggtaagtagcacagaagcgtgcaaggccctgagtataaggctctttgactagtacatagcacaccaccttccatgaagtaggggctcaataaatactcactgaatgaataagtgttgttcttttgcttaatcttccacttgcacatagaataaaacccaaacccataccatggcctacagggcttgcgtgatataactcctgtcctccaacttacaactcatctcacactcctttcagccacatacttctttacctttccattctcacttctgaagctttttgttgtttaccctgcctgtttgtgtagttggaaccacatcatgaccctattctcatcttgaaaagcagaaagtcattcccagtgataagctcagtacagcaaagccactccttggtcaatatcatgttattttcttttcttctttagacatcttcttaacacttatccttattaaaacaatcttgtttcttgtcttattgttttagtatttgtatcttctattagagtgtaagctcatgagaagaaactttttttttttggttatcttcactatttcataaactgcactttagcacttagaccaggaaataacacttagtaacaaaagtacgtaacaaataaatgaacaagcaacatctaatttccccaactgatagatgaacaaaaacccaatatccttaattaagtattttctggattaattattgctataacctctaacatcagagattgtttctgtaacctaagcttttaagttacatgctcccaaccctctattatcattgcatcaaataaattaaaagaaaaaacccctttagagcaagatagactagagcagataagagttgtcaacttaattttgtatgattagaagaggatagccaagtggcaacagcttagcaaaacaaaaaccatgacattttgctgtcttgtcggaagatagaaaagagaaaaccaatttatgcagcaggatctattaaaagcttcataactagaggttccagatgcctttaaacgattgtgggatgtgtgtgtgtgtatgtgtgtgtgtgtttgtgtgtgtgtgtgtgagagagagagagagagagagaaacggagagagaaggaaagaggtataaaagcaggaggattaattaactatgagtgtgaagtataagaagtagttagatccccaaattttctctctaatttcccacctagtgaacgtctcccactccaacaagccttcccctgtacacgtttactgtttaagtaaagagagaaaatttactcctttgcaatgttgaagctaagattctctaaatttggggaccgtgggtacagcaaagagtaagagtgagatactctatttattgattgaaagcacatccataatggtaagaaacaagtccccttccttgttggctttcagaatgctgagttagagttctgtctctaagattaagggttggaggagctcttttgggagaatttcagcagcccaagagaaaataactactcttatcaaatcaaactatgcttaaacacatcagttaataaggcttgaacaaacagtttctaatcagctttttattatcacacgctaaaatatgaactggcagccaataaatagttgacatttgaccaaaacttctagcatatgagacagatcaaataaccaagaatagtctcagaggagaagagattgatgagggagagaacacaaaatattatttaattctatagtaattaatttcttcagatgaatactaacaaaacagaatagtttttttgttttgttttgtttttgtttttgtttttgtttttgagaccgagcctcaccctggagtgcagtggcatcatgtcggctcactgcaaccctgcaaccctgcaaccctgcaacctctgtctcctgggttcaagcaattctcctgcctcagcctcctgagtagctgggattacaggcacccaccaccacagtcggctaatttttagatttttagtagacacggggtttcatcatgttggccaggctggtctcgaactcctgacctcaggtgatccgcccgcctcggcctcccaaagtgctgagattacaggcgtgagccactgcgcccggccaagaatagttaaagaaaaaggttacttgtagaaaataagaaagaccttttagtaataagatagtacaaaataactacaataataatttaaaacagaaaatatttaaaaatccattgaaattcagacaattcagttggggaaatttccccaaaaggagaacaaaaagatagatataagtcaataaaacagaaatataagttactggaggattagatcaagagattcactatccagctaacataagtaaatacatagaaaatggaaagtggaaatgatggacaagagattaacaaaaaaattagaaaaatttttagtatcacaagacatgagttttcagctttaagaataattagcttcattagtcattccacaatgtatatacatttcaaccataatgttgaacatgaaaaaataagatatatgtatatataaacaaaaccaaaaatctaattatgaaatttcaaaacatcatagagcagacattaaaaattccagagagatgaaagaggtcagaaatcacaatgctgtcagccttctcgacaaaaaaactgaaaactagaagaaaatcgataaatgtttttaaaattctcagacgactaaatttacatgtaaaaccaaactatgaataaaatcatttgcatatactgtgaatgcaccctttctcaaaaactattcgaagatctactctaccaaggtaggaacatacctcaattaagaacaagacatggaatggggaaacagatagtccaacacaagaaagaaacataggatcttaaggtaagaattgattgattcccaggataactgctgggcagcaggcttagagggtagtcagcagtaatagagcagaaggatgcaaggtgccaggagaaagacttcttagtatgtgttaccattttgagaaatgttacagagttttaatacaaatgtaaggcttaagtcataagaggtctattgagaactaagaaaagtataaaagtgggtaacctgtattggcaggataaaaggaactggagaagaaaagaaatgtaatcgtactttgctcagctatcaccaatattaacagaattataataatgggaacaatgatcattaacaagacacatgtattattatattcagaggacgggagaaggcaatgaatgtttgtcgaagagaaggagtagtgaaaaaatcaatcctcaccttatacagtaaccacaaaacatacataatttttattttacattttttacagatttgacagcccccccatccccaactcccctacccttgactgtttgtcctggggtatgctaaatgtgcaggtttatttagtgaaaatcaatcaaagacacaattcatctgagacattgcatcacagatgcacatgcagggactgatgaaaatgcttcatgcactgtatttatttcaatttttcacaatctgttgaaatatagcttgctaatgagggacaagcactttgaccatgctgaggtgggtgaaacataataagcatatcatgtatcatgttgcatacatcatgcactgtaaggtaacatcaataaatcacttattatgtatatctgcctgtttcaggccattgtagccatcctgtgcaaaaagtccatacgtcaagtgttatttttaaaaaatgagaaataactctataaaaatgttatctaggaagatcaaaaaaaaaattgtgtgagctaggaaccagtataggagtagtatggggaatgaatattctgttttactataagcttcgtaaggactgcttgacttttaaaaaaatgtacatgtattgcattgaaaaaaattaaacgaaataaaaccaaagcctttctctttaccatatataaattattttgtaattaagtgttaaatgtgagcatgcttgtgctcacctacttagaagttatcaaatacatgtatgtttgattcaatctcatatttcaattcagtatatttttcaaactgggaaactaagggagcttgccaaggtaaattaccctagcaaatatacatttgacacatcacataatattctaaacacctcttatatctgttattttttaaattatgataaacaaaatcttattagtaaattttattaccaacattttaaacctctcctgatctagtgatcttatttcagttatatctgacacaatttcaattttaacaaaatagtagtacttatcatttactcccatcacaataccttaataatttcttgttagttttaatgattagctaagctcatgagcattaaatataaattacattacaaggttccaaaagcaggtaaaaattatcagcaacaaaagtaaaggcccaaatgggaattaagcaatatcatatttttcctcaagtataggagtatctttaattctctttagacttgatataatgaggtaaactctatacaaataaaaagtctctgaagtttcctttttctataaaactcacacaatatagaattctctccaacgtatttaaaaacacatacttttatagtatgggataagcacatggctcttctgagagtaaaagataataaaatgtaaggtattatttgaaaaaaaatgtgcctaacaaaatttttcaaatagactaccataaatgatatatatcccctaaaaggaaataatatggtatccaaaattataataaaatagaggtttataatctgttgttataaaaagccttaaataggcttcaccaagaaatgtgtactattcaatatgtgaagaaggatatatatttaaaagtaaatacactaaaagaaaaaaatacaatgtaaattgcaaatttctcggtatgtatatatcacatttttatgactctgtatgtgaaattaactcaagccacctactgtattgactttattgatggtaatttcttatcaacagcatgaacaactatgtccattattcaaaatgtcagtgataagtcaaacatggaaaaataagactactggcccaaatatcattttctttggctttagttttacttcaaacattgtatagaccaatccagtaaatgaaaaataaatcctgcaggcttaagagaaaataacactctttcatgtaaatgagaaatttcctttggagtagtagacagcagaataaaatattgataaaagcgggggttctagtttgagcagacctggtttgggattccagcttgacaagtctctacccatgcacacttcaccactcttatttctcatggcctagtgctataattctgaactatatggacaataatagtaacctgctgaactctgctgtgtctgttgaacaactgaacaatagcaatggggctattttatatagtgtttggagtaacaaattaagcattttatgaaaagcacttataacctagtgcctgtccctatagcatagtggagctaagtatatgtcagtaatctaaattgtattcaatattgctatatgcaaataaagtgtatgagaacattaccttttatttgtcctaagctcattctccttcaaaaagatcacagattaaaattttgatttatttggaatagagttattaatttttttaaatttccaattaggagttgcaatattatttgattattgcataatttatacaaaataacatttagcatctatatacacacagacagtgacatacatatattaacacaaaatctcagcactcaggctggtgtaatactcttcttcagaggcttgttagtgatttataaagtaacttaagcatatttaagtaatatttactcagtggattaagcaatacattttgactcatatcacatatttattcatgtgtttaatacattaacatttattgtgcatgcacagggtgccacacatgcattgaatataaggaaaatatgaagacagagtttgcaaagaaagcagggtataaaaggagatttatagaaagaaataatcggcagaggtatatggaacttacagagacagcggacagtgttacttctgtctaggagaatggaaagtgtctcagtgtgatgtcatgttttcagctaaatctttacagataagtagaaaattttatgctcgatttgttggtggctggaagtaactgtaatagaaagagagactaaaattggaaaaattatggaaaccagaaaaagtgaacagtataattggagaataactcagcatacatattattacaaagtggcagaagctgagattgaaggggttgttaatggtcatacattgaaaggccttaaatgcccaaccagatattttagaggtggaaaagataattgccttttcctaacactggtgggcttacaagacccccaaaagaaatatatgtagagatacagagaaacagtgtaatttacttaaagaattacatataattcaatatttgtgatatatagacaatgaggtgaagaataaactaatatacgtagccagaatatagctttgcatctctgagaaatatggtgttttagcacataaatgatggtatcttaaatagggtttattggtcgcaagcaacaaaaattgaatctggataattcatccagaaaataaacttgttgaaagagattgagaagttcctaaaattgctaagaaatctggagaacttttgttgaaggagaataaaaccaatgtaattcttgggatgtgggtcccaggtacttacaaagagtcttgcatactgactcccgaataatgtaaagtttaagtcattgttccatttagttcattattcaaagtaacaggagttgttttgagtaaactacctagctaaggccactaagctaatcctttgagaatgcattcttgcttattatttcatcaaattacacaaaatggagatgatcgtctaaaacaaaattggcaatctattccaatgaaatgagaaatgaatgttgattccagaaattagcaaatttccattaaggataggaaattattgtaagctttgaaacaattaaatggcatgatcaaatttgtttttagatggatggctgtcttgcatggatcaagaatagaaaggaagagtacacaatttctaggtattcaaattgtcaaatgaaaaggtgatgatttttaccaagacagtgaaaaagatacagctatcttgtgacatctttgaaataaataaatcttaaattacatatcaaaaataatttattactaaattctcgatatttgcttactttttcttttttctgtaaagaacaagtagaggaataaaataatttctataataagattaataataggaagggtaattatatttccattgtttggacaatatatttaattctgtcaaagctgtgccaggtttacaaagagtttgtcaactttatttttaacaaatgtagttatataatttgaaacaattatataatccaaaccaactttatatttatttagatgaaggtctatttgaccctattccatattgtaacactgtcaaaattatagtctgtgttttgttgaattttagatatgtgaagtttaatgaggtagatgttaaactttttttaatataaggactcatatgttatatttagatatcattgggagtaattttatcattcaatttgtaaatactttttaaactttataatattcagtgttaacattcatggaataatattttgtggattaacatttaaaaagtgaaaatttgttagggagaaaatatgaaataataattttggaaaagctttattcttgtagaaagttattttataatattgcatacagaataatataatgtataatgtttttcaaaaaaagttacaaataatctgtgttaggcagaatctaagaggatccctaacatttccccacttcctggaacttacatctttgtacatttcctcctactgagtgtaggctgaacccaataacttgcttctaatggaatatagcaaaaatcatgggatattacttcaatattaagttgcagaaagtttgtaacttccaattgggatgctcattttatttcactctcttatcttctatgatcaaagccagctgccatgtcagtagatgtctaatgggaagtcccatacataaggaactgaagactgcctccacttagtagcaagagaggaactgaaccactctgcccaacaatcctcaaggaaacggatcctgccaacaatcaagttacataagctccaaagcctagtctgtcccaggtaagccttcagataaaataggagcctcagctgagatcttgattgtggccttttggaatgcattgatctagagaaacttcagtaacctgtgcctgggcatctgaagtaaactatgagatagtaaatgttcattgctttaaaccactatgttttgggacagttagttacttagcaataggaaactaatacacagatatttggagaaaatattgtctcataattttctttacattaaaatgatgttatacttctgtatatttatagagataaaaatatggtatctatactacttctatattaactaaaaattgttttgacatgatggagatacaattaaatagtcttggattattaaaataaacatgctttttcaataactttcacgtttctcctttatatacaaaagcttttgctttatcaatagctttgcttttactttcagttttgtttaaccgtggaaaacacttttcggtgtatgtttaactgcaaagttatttctacctcacaataattagatgctttactgctaaactggttagtttttagagataaaacttaaactatttttagattcataaagcacatgaagaataagaaattatagtaaatgcatgagagtttagacataatataatcaatatctcttttttgcatagacatgtgtcataaggataagaaaaataaagtcaacttcataaaatgcactgattcatttttttactcaaatatttgagtaaactttaccatttttttctcctaacaatctaccagatttgtgcttttctaatctcctccctagatatgcaaattataaaagcacagtgaagagagagaaagtgtggttttgacaccttactatgttggtttcatgccttcatgagcaattcaccagatgtaaagcattggaatgaataagataaaagcaacataattatttcctttattttcttatgagaaacaatatactatagtgctttgtttctcaaccattaataaataagataatgtatactgttatccacaatgagaccacccccaaaaatgattgtgacaaaatgaaaataaagaagatgaacgagtatggatgaagccaatattaaaacttcactaaacacaaaagctcagtctcactcatcttatattacctgaaggctatgttgatagctatgttgcgaagaggtgggcaggtgaggatggcttcatcagtaagtatttagatgtagtctttacatatacacccttcccctcttgacacgcacacccattaacccacatatacacacatcaaattaaaatctgaatgaaagagctctgagtttcaaatattaaatcaaccaagtgtaataggattccacaatctagaacttgttaatagttgaaatctaacttttctttgacatgaaagttacagaaatattgtggtgttgctaccaaatactcaaaaacaatgttttgtaagagcagatcttcatatttaaattaaaaaaaattaaatattcatttttaatgagttaatatgaaaaatttaatgaaccaataagtacagatttgtcattttttttttctttgagacagggtctcactctcactcaggctggagtgagtggcacaatcatggctcactgcagcctcaacttcccatgctcaagtgatgctcccacctcagcctcccaactaatttttttggttgggtggatttctttttgtagaaatggggtctcaccatgttgccgaggccatcctcaaactcctggcctcaagcaatccacctacctcggcctcccaaagtgctaggattacagatgtgagccaccatgcctagccaagatttgttatttctattgagatttctgataaaacatgtattttgagacaataaaattctaaaatatttgcctaatagaatcacacttttttattactcatgaagtccacataattttacctaattattacaatgagagtggtaataaacattagtacatcgttcataaatatgtcaaaagttttatatattatttttattatcacagctgatcaaagtatatattattatttttctaatataggaaaatggtaatgcagtaagattccataatttttccaaaatttacaaaaataagttaaaaatccataatgaaaaccctgccatgtacagccacaaagtctaggtttgatataccacctcaatataaaagtcacgaaatccagttttaagtcggaaagaagtgaaaaaataaggagtttggcattttaaccaaattttaaaatatatcaatttctgctttcatattataataatttaaattagcaaccacagtggaatttaacaattttatacatgggtaagtcaaacgaggacatgaaagtcattataaaatggataaatttatgttaccagttagactcagtcaagtccaagaccctcctttttctttctctttgcctcatattttctcctagtaaaaatttccattcgtaacttagtcctttgattcgtcaaccctaaaaaatatggaattatcttccaagctgtctttgtactttataaaccactgatttacaccttaaaaatcttttatttgtctacttttcttaaagtccatacattcttccccagaaagttctcattcaatagaaactaaatttaagataccgtattatgctatgagaagagttctcattcttcctagcaaatgcaagtctatgctcacattgcccaaacttcacattcacccagggaccataaggaacaataagaatcttctggccaggagcggtggctcaggcctgtaatcccagcactttggaaggccgaggtgggtggatcacctgaggtcaaaagttccagaccagcctgacctatatggtgaaaccctgtctctactacaattacaaaaattagccgggcgcggtggcatgtacctgtagtcccagctacttgggaggctgaggcaggagaattgcttgaacccgggaggtggaggttgcagtgagccgagactgcgccactgcactccagcctgggcgacagagcgagactccatgtcaaaaaaaaaaaaaaaaaaaaaaaaaagaatctccttccattttctgactggaatgttagtttaaaatttaaagtatagattacctttaatgtaaaactgctggaacacaaagataatagaaaaaaagacatttgaagtctggatcaccttagtctacctcctctttcttttattctctgtcctgctgttttttttcttaatttgaaaggtagttataatattcaataacatgcagtgtttctgttgagtttgaatagcttgatttaaatgaagtatctagcagacgtcttgttgcatattagatactcagtaaatggtaaccatgagtattataattaaataagcaccttcttgctctaattgtactggaaaatgcctcttcaaaattattcaattcagacaaattagaaggaacattagaataatgtctacagaaatattccctgggatgtggttgaaggtaaactgagtagaacaagagacctttctgaaaatacatacacttacacccttcaccatcataatacaagtggtttgattcttaattgctcagttaatgaggtgagcaacaggaagtgtgcatttaatgagatatactaattttcaaatattgagcaatttgtgccttattaaacattaatagaaatgcccatattgctaatcaaataaaatatcataaaaagaaatgaaattcttccacaaattaagttacaattctacattttaaaggcaaaattcattctgtattttgaaataatactgaacattcaaaagttggcgttttcctattaaatgtacctagcttttatatgaatcaaaactatacatatgatggaaaatattagctataagtgtacatcaacattaagaacattatatttatacaattggtaaatcatagtgcattactatatgttttaaaatacaccacataattctgataaataataaaataaaatactaatataattgattgctgtaataatttaaaaatatttgcagaaatagattagcttggtagaaatgtaatatagtatttctattcaaaagtcacgtgtacgcatcactggatcttattttgcaacagtactataaagaatttgggcttaataacatatcaaacaggctagtgtttgatgtcattttaaaaaactataaatttatgtattacttgcaaacatgcagaatctaacaaatcattttctcagtaattcatttctttttaacattagaaaagtttaaaactttgtcaggtaaacaattttttagatagactttgagggatgaaatcggctgcacaatgcactatattggtagagctttttatatatttggttttctgaccgctgggatttctgtgttgaagaaaaaacagccccttcttttacttaaagacaggttatgagctaatttgtatttctagctcagaattcttggccatttttactcactcttcatgtgtatttcatatattatctttaaaactaactttaactcataaagaatacaagaaattctagaatttgaagtatctttcagtctttccattttacaaatgtgaaaactgtgttttaatgaatttaaattacttggtcagtcactcatactgttagtaggagagatttcagtagattatcattatttgtgttcattacaatgatttccttcttagtgcaaagagatcattctaaatttgatgctgtataattctctatattcagaaatttggctacttacctaaacatcaaacaggaactattattattgcacaacttttaagggcaacctgattggatgatacttattatgccttatttttttcctctgaaatgttattttgttttaaaccaaaaaatagaaaaccttggtagattgaatgcattctgtagatatttaagaaatattttcaatgtattggaattcaaaaaaaaaatggaacataacaacacattatataaactattttaatattcaggatgtacaatattaaattataaatatgatcttttttcttgatgaaaattaaaatgactaaaatttagcttttagttaccactttgaatacaaaagagaccgtacaaattcaagtctttttatcatttgaatttaaatacacaacctgcagtgtgttaaactgataaacacttaaaaattatatacgtgatttttgacctgaaataagatttaacttaaaaataagctttagtttatctataagacttcatgcattcatattttcttttttttttttttttttttgagacggagtctccctctgtcgcccaggctggagtgcacagtggcgcgatctcggctcactgcaagctctgcctcccaggttcacgccattctcctgcctcagcctcccgagtagttgggattacaggcacccgctaccacgcccggctaattttcttgtatttttagtagagacggggtttcaccatgttagccaggatggtctcgatctcctgacctcgtgatccgcccacctcggcctcccaaagtgctgggattaaaggcgtgagccaccgcgcccggccgcattcatattttcttaaggaccatatccaatactgagaaaattaagtgctaattagttaagaaaataaaacaattttttgaataaaatatatggtttaatgttgaaacaattgaccttgaatcaaccaatgatagcctttaacaagaccacaaaagtctcatttattaaacaaaagtgacacttctaaattactttgggcagaaaataatttatttttatttccattttatttttaagttcttgaatcacttttttctcttaatttatatatatttttaatttttatgggtacataatcattgtatgtatctatggagtatatgtgatgttttcatacaggtgtacaaggtgtaatgaccaaattaaggtaactggggtatctattgcctcaagcatttatcacttctttgtgttaggaacacaaagtacttttgtaagcacaattccactcttttagttattttaaaatatacaatgaatattgttaactattttattcattctatatattttttacttattaaccatttctactttattccccactccccactacccttcctagcctctggtagccaacagtttactctttatatccatgatttttatttattctcattttttatttttagcttccacaaatgagtaagaatatgtgaaatttgtctttcggcttgtgcttggcttatttcacttaacataatgtccaccagttccatccatgttgttgcaaatgacaggatttcattattttttataaattaatcatattccaatatgtatacgtacaacattttctttatctgttcaaccattgatggacccatagactgatttcatatcttagttattgtaaataatgctgcaatgaacatggtactggcataaaagtaggcacatagacacttgcaacataatagagaacccagaaataaatccacacatttagcagtgatctcatttttgacaagggtaccaagaacttacactgagcaaaggatagtctctttaataaatggtgctagcaaaactggatatccacatgcagaagagtgaaactagacccctcttgccatatacaaaaatcatatcaaaactgattaaacacttaaatctaagaccttgaactatgaaactagaaaaacactggaaaaacattccagaacatttttctgggcaaagatttcttgagtaatacctcacaagcacaggcaatcaaaccaaaacagacaaatgggatcacatcaagctaaaagcttttgcacaacaaaggaaacaatcagcaaagtgaggagacaacgccttagaaaaggaaaatgtttgcaaaccactcatataacaaaagattaataagcagactatataaggagctcaaactatctaataggaaaaaataaaataatctgactataaaattggcaaaatatctgaatagacatttctctaaagaaaacatacatatagacaagtatatgaaaaaatattcatatcaaaaaaattctaatcagagcaatgcaaatcaaatctacaatgagacatcacctcaccctagtaaaaatagcttttatccaaaaacaggcaacaatgaaggatgtggaggaagcggaacccttgtacactgttgatggaaatgcaaattagtatacccactgtgaataacagtgtggaggttcctcaaaaaactaaaaatagaactaccatatgatccagaaatcttactactgcatatatattcaaaagaaaggaaactgatacatcatagagatatcagaacctcttgaatctttcttcatttagtcaatattacaaatttgtatttaatatacaaagtagtatgacatgtctatactctatcattgattctaaataattttggaatttcatcaccctacttttatctactcaacaattgtgccctctaccccaaccaacaaaattattgtccatttaaaaaaccaacaaattaaataattatgcatgctaaaatataaactgctgttattattttcagaattgtgtttagtcttgcaacatcttgacattgtgaaacacctaaaaatgaaacacataatgtattactaatccttcttccatgcttagatgatttctaaagacctatcaatacaatagatgtaaaataaatagttttgaaagatgtatgagtgcatgcagatttcttttactgttctgcaaaacagttcataatatgtttctctgtttcttactgatgtttttatgacagttcaccagagctcttgcatttttaacatgtatccttattcgccttattactatacttttatttttattttaaaataagtatgtattcacaaaaattgacaaaaataatctagtgtttcttattaccaagcattcttcaaaagtgacacattcaaaattatagtgcactctcaaaaccaaaaaattgattgttataatgcacatctagaattgaatattcatttttataaaaactgttttaagaccgggcacggtggctcaggcctgtaatcccagcattttgggaggccaaggcgggcggatcacgaggtcaggagatcgagaccatcctggctaacacagtgaaaccctgtttctattaaaaatacaaaaaattagccaggcgtggtggcacacacctgtagtcccagctactcaggaggctgagacaggagaatcgcttgcacccgggaggcggaggttgcagtgagccgagatcgtgccactgcactccagcctgggcgacagagcaagactccatgtcaaaaacaaacaaacaaacaaacttctaaaatatggctcttcagcaaaaactatcactggtttaaaattttctcatttattactgcatgcttatctatcttcctcattaacctgcaaatgttgctgatttgagcatttatcaccattaaaattaagttattttgaaccacatggtagatttccctctcattttgaatttatttattctttgttaaatgccctttcttttctttctcactctgtcgcccatgctggagtgcagtggtgtaaatgcagctcactgcagcctcaacctcccgggctcaagtgatcatcctaccttagtctcccgagtagctgagaccacaggtgtacaccaccgtgcctggctaatttttttgttaatttttgtagagacagagtgttactatgttgctcaggctggtctcaaactccagggctcaagcaatcctcctgccttggcctcccaaagttctgggattgcaggtatgagccaccacgcccagccactttgtttaatttctggaccttctcataatcttattccttctataattgcctccttctacttcattttcttcatcaaaagcacaatttcattcttattttacctggatttctattctgtatatcattaacaagaaaatagtattcattagaaaccctaaaacttttctgagttagaacttatcacaaatagattcaaaactcataaaacgtgttaccagtgtttgtctctgcatgagagtgaagtgataaagattatgtggtttatgttcttcattggtttattgagaacacataatagtatttttgtagataagccaagataatccataatatatatggaagtatataataaaacatagactgcacgtgcacatgactagtgaggaggcagagtgattatatgaaattttaataagtccaactattagaaagaatgttatttcttcttagtttccaaccactggtgttgcttcagttcagtgtgtcagttcctatgggtagctgcaagcatatatcagcttgaaatgattatctttctctctgtgcagcccacttcctgcttgtatgtgcaaagatatttgagaatggatcaatcccaactataatactgtgtgtactatttaaattggatataaatagctaatgagactctaagttgccactgctttgcttgtaaatttatattagttacagaactttgaatctgttaaatcagagttttggtttctacataagaaaatagccttttctaaaatcaatttaatgtgtaaatatatagtttttgtgtttgctttcctttcatttaaatgagaagataaaatcacaaactgtcggccaggaacagtggctcatgtctataatcctattacagcttttgaggaggctgacaggcagatcgcttgagcccaggagttcaagaccagctagggcaacgtggcaaaaccttgtctctacaaaaaatacaaaagaaaaaaaaagtagctgggcattgtgatgcatgcctgtagtcccagctaccctgggggttgaggtgggcggatcatctgtgcccaggaggttgagccgtgatcccaccactgcactccagcctgggcaacagagcgaaactctgtctcaaaacaaaacaaacaaacaaacaaaaaaggcacacactgttagtaattaagtaatgatgaattcacaacttataataggttgaaggagttaaaaattaataatgaagactgctgggagaaaatgatttggaacatttggaataagttttaacagatattttttctagaggaaatggaatagagaccttacagaaaattttgcttatagattttttttcaaaacaactttcatttatgataggaaataaaacaactaggagtaggcaaaaagaaaacaaagaaactttgtctgaaaaggaagtttattccccaggatagtctatcagttagcagctatgctcataatgagcataatacagtgcattttcatattccattgaactctgcacagcttcccccaaacacacaacaaatgaacaagagtagaactgcaggcttttatttagttcaatattgcataaatattaaatgcagacagggaattgcaaatggcaaaaggagactctactgaatgtaaattgtgatgaaaataccatggggaaataatggtcccaatttgctacttagaaagaaaatttatgtgaataacaagaccagactttccaaaaacctccatttaatggttatctaccacattctgttgttacagaggttttgttgttcaatttctttacttttcctaggatggttcacattgatgtttctcctggagtgggttcttaccctatcctaaaatgaaaactacacatctactcagtaggaaccagtgcatttaaagccatattgtgttctgtgactagcacaatgcaaggacaaaataaatgttaaaaatgaataattaactgacaataataatcaacattctggctttaaaaggctcccagaaacagtctctctaaagtgagctctcagtgtctcctttatttccaaattcagaacagctttgactcaaatcactgaacattgggcatgaagtaccttcctgaatttattcctttgtttagaagaaatcatctgtatcttattgtctctctgaatgctaaatgtgaatggctacttctcacttagcttgtcatttgactctgtaaaataatgtaaattcgggttataagtgtttctttataaaactttgtagtcttggatatatgtctggattttatatattatataaaatcataatattttctttcaaaaaatcattaatgtcaattaaacatcttcaaaataagaatattctgataatttgtctttagttctctttagagacttctgaaccacattgatctggaccaaaatggaatgtgatgcacaatctcatagttcgaaatgaaaataaaattctactttccatttccttgtcaaattgttttctgtgtcttgcactgcactacagtggaatttttgtcatttctgcttgtcttttatttaagctcattctttaatactttttttagtagagtgaaatatttgccaccttctctagtgttaaaaaaaataagctagaatactaacatgtatagacctctagaaataatagaagaaaacagtttcccctctacttgaaccaatgttccccagaatatcttttctaaattaaaggaaatactggacaaacatgaaaattcctaaaccccatgtgagatttatggaattcgtatctctgaaagaagggcaagaaaatatgcagtcttcacagttttctgagttgttctgtgtgtaacaactgaacttatacacacacacacacacacacaaacacactgaatttcaccatcctccaccagaattttctagttcctcacctcctggtattcttgggaacaactgatatcaaagcattacaatataatcttgagttcccaatggaattcactaacatgagatacattaatgtcagaatacaggaatccattaatttctattagaaaattatttccagaatctagtatgtgcagaaatgtagctgttaatataatccaggcagccatttcattgaaaaagtctgaagaaagttaaatcactttatcgaagatatggtaagtctaatttttgctgtagattaacatccttcctaatgatgaccttattttttgcaccattattgttcccttaaataaatgatacaaatattctttctgtcttctattctgaaggttcttcttttttttgaaccattgctatctttgaaatctcaccagttttgagaagttactcatgcaaaagttgaaaatcaaagtggttttgcatgagtttaaaacacaaagctggtagtcaaagaaatcaatcactttttagagtgtatcatgatgtgtaaagcataaaaatagaagttactgcttcagttctattttctagaagtataaaacatgagtttaaagataaattctcttcacttgtcttcacttagaaacatttgctgtaatgttttgaaacaagatcctcaacagaatttaatagaaaacaaacgttgtaaatgtgaaagtggtagagatggaaaatacaaaacaaagtaattaaaaataactcaaaaaaacagaaaacacccccccaaaacatcttatattactgtattattgtgttcttaactaccattgagctattgaaatcaaatttcaatgttgtatgcttatttccatatttttattctgacccaagctatggaaattcagtcttcttcaactagattaaaattcaaactgccaggtcattcagaaattgctattcctagtatctctattaaaaatggattatgttcttaaaatccttcaatgttggagtatttctgaaccctcaaacagaggcgaatactctggtaattacttcatatatgtggtgtccaaaaatttgcccaaaatcccagaatatgtatcagaagagatggcactctagtcaatatgatcaaccctattagatctaatgcctggccccattgtaatattttccccagcactctatgatagatagcataacacgaatttgtgaagattattttccacttctcaaaaatgctttccttagatcagagtagacagcaaattcataccaaagcctcagaaaactaaaccaaacagttctatgctggcagccatgcctaaaaggctgacttagggcagatgtgcacttggcaatcagtacttggctaaattactcagttcctggtgccatgataataccagtatcctacacagagcagcatctggaaaatcaataaagcaaaccaaagtttgcatcaatggcccagaaataggtcttttatcactattttgctgttccagccagtagctattcatggtgactttcttcaattaagagataagagtaaggacaagcataaattttagaagtctcaccataatcggctatgaataaatatcaagctaattgaagatttttttgcatgtagtttcttttctcatctaggttctagacttgctttcacagcactctgaatgatatccaatcagatatacatggatatatgaatattgttgctttgagaatgaaagataatattgagaataaatacacgttatctgtattaggcaaagtatatgagggaggagtctgaattactttcattttctcagctaattttccagtgcctaagtggaaaggctcaagttgcaaaagaataatgaataatataacaacaaagcactcaaattggaatttaaaagttctcaattgtagaaatattggatttatgacctaatgggtaataaattccaatttaggaaacttttgtttctaatctaactgtattatgtaagaaaagaaaatagcatttcaaggcaacaaggtacgcaagccactgtatgtactcagacttatgctcatgtgtatcaggtgtcttattcataaaagttagagatcattttgcaaaaaatcatttattacagatgaacttagtggagaggttaagacatttgtaggtttatgcagagaagatctaacattcttttctttttagttatcattgtttcaattttagactaaaattatattttccttgttatatattaaactgcagaggaaaacagcacaaaatgcaaaatatcccctttggtctaaactttcagtgctatttttcttctcatataaaattattatttttgcttgatatgtaggtctctgatcctctttttctatgttgattaacatacatgagtaaaagtttaagcacaaatatgcaaacatagattcatacctaccccacatatttatgttttacacaaatgaagttctatttttgaactatttttatcttctgtgtttcatcagttgacactgtatcttagagtttgttcatgttagttaaggaaaatctttttcctttaaattgctgcaatgtattctttagtttagatttttcaacactttgtttaaactctctcatagtggccagcctataggtagttctagttttcataatgggaaaataaaactggtgtagaaatcctacgtacatattcttatgtacaagtaagactatttatttaatgtaaattcacagaagtaaatggcctagtcaaacaggccatgtttatttccaattttgaaagacagccaaatttatatctcagaagtctctgtccatttatactctgcaaagaacatttaagagagttatccagcatgttattttttgggctggaggtggcatttctgtcaaactgatagctgagttaaagcagtgcaactttgcatttctgtcaaactgatagctgagttaaagcagtgcaactttttacatgtttatcaccattataattcttttttttttttaaacaaaatagaggctaggtgttgtggctctcatctgtaatcccagcattttgggaggccgaagcaggtgatcacttgagctcaggagtttgagaccaactgagcaagatggcaaaagctcatctttacaaaacatatacaaattggccaggcgtagtcccagctacttgagaggctgaggtgggaggattgcttgagccacggatatcgtactgagcccattgtgcagttcactccagcctgggtgacagagtgagacgctgtctggaaaaaaaaaaaaaaggaaaaatacatttataggttttatttttatcctattaaaatggaatacttttataattacttattttgggcttttttttttttttacaaatagtgtcactacagaaactcatttgtttatttctatttttatatacatatatttatatgtacaattgtctttcacctttacacttgtatttgaatatatatcttattacagaggttggggctttcttaatcttttcagtgaaatctgtccattttttacatagaggtagaagagtactgtatctgctcaaatacatacacatatatatatacacacacaaatatgtatacatgtataatactatatatcagattttatgatgtttagatatcattttgaaaaaaacacttattatacatgaacttatagagaggctaatacattttgagagttgtaaagacaaattttcaggtttttgcattttgtatctgccttagaaatatatccttaattcaactattataaacatattcctaatgttttcttgttatgtttgttttacatttatctattcaattcatctgtaatgtattttggggcctattatgagataaaggccaagatgtatggaattataaatggatacgcggataagcatccaatagatatgaataaaaatatttagtattgtaaaaatgtccccttttttttgagacagagtcttactctgtcccccatgctggatttcagtggcctccctgcaacctccacgtagttctagtgattcttgtgactcagcctcccaagtagctgggattacaggcctgtgccaaaatgccctgttaattttcatattttttgtagagacagggttttgccatgttgcccaggctggtctccaactcctggcctcaagtgattcccccacctcagcctcccaaagagctgggattacaggcatgagccaccatgcctagccaattctttccaaagtgatctatagatttaatgcaaccccattcaaaatgtcagtgatatgatttaaaggacttgacaaattgatactaagatttatatggatgagggagagtctagtacagccaagtcatatttaaagacacatttaaagacaatgtgggcatgtcataccttgtgataaaaaagttgtaaatctataaaaagacagactcatttggaagtagatagataaacaaacgataaaatcaacaaacagagacaccaacctccgtatatatgaaactttatagaggcgacatagtataatccgagggaaaagcaaatgcagtagagatcttgttgttagtgtgggaaaaatgaaataaaatggataatcatcttacataatagcaatcatctctagatagataaaggacttacatatttaagtcaaattttaaattcttggaataaaacataaattaatattctgacctagtggttggaatgtatcactaaaatatgacagtaaaagcactagttatagacaacatgctgttcatctacctatatgtaattacaatttctgttcaatatttaatactctaaaaagggaaagacaatacaaattgggagaagacatttacaatacatgtagccaaccaagagttaatgtacaacttagatgggtaaggaaaagcaaagacccagtaaaaaagggaaaataaaagtaattatcaaacacaatctgctgaatatcccaacaagcaataattttagtataaattgcaatcttctaattgttgtattagtaaggtgtgacatgcaacactttaatatgtagtagtaataatgtgtctaatatttccatgtaaaagttaacaaatatatgttacacttgggaaaataaaataaatattgtcatgtaattatatatgtatcatatatataaagaacaagtaattaagaaattatatatgaataatggttttattatgtcatgttttttctggtttattcataatttaaaagaaagtgcagattttagacaaaagaaaatttcagtttatattttcatctctatttaattatatcttgaaacaaaatattttggtcatgatctctagaaaaaaaatcacatttttattaattaaccccagtaatccactggtgcatggatatatagatagtttgtaatgaagtctctagagtctaaaacaaatgaacgtaaattttaaagaagtaattttgtttttcttattctgcttagaccaaaattaatggtattttaacttaatttatttaatttatttatttattgagacagagtcctgttctggagcctggagtgcaggctggagtgcagtggtgcaatcacagctcactgaaacctcaaactcccaggcccaagtgatcctcccgcatcagccttccaagtggctgtgactacaagagcatgctactatgactggataatttatttattattttttgtggagatagggtctcacttttttgccctggctggtcccaaactcctgggctacagctatcctcccttctcaacctcccaaagtgctacgattacaggtatgagacactgcacccaatcataataatatttttaaaatatcagtcagacccttgtaaaaaaaaaaactagtcaataccaaaatgacctaagaaatttaaataaattcttttttttttttttttttttgagatggagtctcgctctgtcactcaggctggagtgcagtggtgtgatctcggctcactgcaaccttcacctcccgggttcaagcaattctcctgcctcaccctcccgagtagctgggattacaggtgcccgccaccacacccagctattttttgtatttttagtagagacggggtttcaccaccttggccaggctggtcttgaactcctgacctcgtgatccacccgcctcagcctcccaaagtgctgggattacaggtgtgagtcaccatgcccagccaataaattcttattggtactattccactatatgttctttttgctttctatacatatcataaatattaaattatcaatattacaaacaaataatgctcggtaggaagtatttatattccctatgtttgaaattatcttacttgtttccattgcactattatggagacaactgacaattcacatgcagttgtaggaaaaaaatacacaaagatcctgtgtaccctttactcaatttccccaaaaggtaaaaacttgcaaaaattatagtacaatatccaagatattgtatcagtatatcgacattgatacaatctataggtcttatttaaatttccccagttttacttgtactcatttgtgcttgtgcttgtgtttgtgtatatttagttttatacatttgtatcatatatgtagatacatgtatctaccaatatgatcaagatactaaataactatatcagtataaggattatttttattgtctttttgtaactacatccacatcactgaagcaatcgtactccaccccatccccaccccagtcctaaaccatgtcaaacagtaatctggtttttctccatttctataattttgtaatttcaagaatgctataggaaataatataatatttaaccttctaggactgatattattcattcagcataagtatgtgtgtcaatattttgttcctgtttattgctaagtgtcccattttatgaatgtaccatcgtgtgtttattcactttttgaaggacatcgcctatatttttagttttgggctataacaatgaaaactgctatgaatgttcgtgtacaggtttttctgtgaacatagtttaaattctctgtgatgaatgtccacaggtccaattgttgaattgttaaaatttaactctgattaattttttttaaaaagttatttttgtcaggatacactaggttatgatgcagtaataaacagtcatttattttcaaggcttaacaaaatgatacacaatacatgtccaaagacagtgagtaggacagatccgctaattgagattactcaagaactagggcaaatgtagggtgtagtcaaggtttacttgtcaaaacaaaacaacaacaacaacaacaaaaattggctactggttcacaaatcccagaagaaacctgatatatttctgctcctataagttcagaaagcaacataagggagatgaggaagtgctcaaacaatatttttgaatagcagtaacaatcattcattgtcgaccaagctttaaaaaattattcagatttatgtttgtcataaaatgatatttgttccaccaaaaaggtataaacacttggtagcatttcctctcctgtgactaatgagccttttacagagttataagcaaaatccccaaaacattcagatcctgacagagatgtattttctcgggcaacagattacaccctacccaaataggagtgcaaataaaaagctgtagcacatccaaccattcttcagttatataaatcaatacctgctatgtctgtgccctagatgtaatcctgtcttagaataaagaggttattaaaaaatggaatatccacttactcttcctttttaaaaaatatttaattattatttatgttaatttcccaaattataaaatattggaactgatcacagtacttaaatagttctataatattttcatctatccttagaaatccaaagtttttttcctataattaagcagttaagaaatataattcaacatttaattgagtaatataaacattaattagctgagaaaactcacgttgaggagtctaaaatattagtgaaccaaaaataaatccaagggccaaggggggtaaagtgataaaaacctagagcaagttagctttaaaatttgaaggaaaatgtttcactatatcctcagaaaaggtaaaagtcatcaataaaggagactaatttaagctcaaaggaatgaacacacacaaacacacacatttaaactagaagacgattacaatttagtcactaaagaaacctgtaaaatatattttaaaaactgtctaaaataatgatattcatcaataaatatgtaatttcaacattcagctaaaggagaaaaaaattttctaaaacaaaataaatttttgtccaatcatgtttagttagcatagaaggtctggaatggttgtgatgacattttattaaataaggcaaaatttaagtataaatattgagggtcatgatacctgtttaatttctcactattatgaagtttcaattatttgtagagtcatggtctccatctaatggattctaaacaattcaactgaggagaaagacaaagacagaaacagagagaatggagagagtatagggcatggagaaatagagagagagtatgtgcgtgtgtgtgtgtgtgtgtgcgtgtgtgtgtgtgtgtgtgtgcatgcaagtaagaacttaaagtttaaccaaaccaaatatttagtagaaaaacatatttctttcttttctaaaaagctgagctggacaactcctaaaccatcctgtcgtttctcatatctgtatagtttgattcctatgctttctaaaattttactacctaagtcttggaattcattcaagcttataatttaatttgtattgaattactaattgttatcatagtttaactttttaaagcaaatacaggaattgctgagatttattgagaatgtaactttactaatacagaatgggatagcaatgtgccattgtgcattttaagtgaaccataataagttttttttttcttttttgttctaggagaatttgaagctaaatttcagaaacatataaacctattcttgtaaagtatatggctcattcagcaatgcacataaagctgaatcactgaagtatgctgattgatcaatacagtttgtggctacatttgtaaaatgggtaaaaattaaagcatttcactatttggttcagtaagttgagtgcataatggttcaaacagtattttatgcattttaagtcaagcacattgtacactgcaaagtagtcaaccgtgaaaacattcaatgattaggtaagaatatcaaatttgaaataaaattagtaatttagacagataattacacaaaatgctggtgagccactgaatttcttttatatgtctctatcctttaaaaacgtttagtatctcagcatcttttatacacaggtcttctttgaaagctacttgattgttactggtagaaggcatgaaaacgcatttattacagttgtaaaatttataacatatgatagcaatttataagtttgatgcatattgatgtaacttaaataactaaaatcacgctttaaaaatctggttatttatatgtatgtctaaaaccaatagttacttccaataccaagaaattataacatggtacataataaggtaggtttttcaaaagagactcaactccttcagttgattttctatgtggttatggttataaaatggatgtctcttttgagtgagggttttggaagaggctatttttttagggactatggttcagagacaccaaagtttcaattacagcagcatctagaacctttgacccaaaggctctacctggaaacattggtaataagagcaagatatcttttccagttgcaagctgtcagtggaaaggtgagtaacagaccaaagcaaaagaggattcaattgaacagaagtttataatcttctactatttggtcaagacaggacatagaaaaaaatatatatcaagattgcctttctcaaggaacctaccatttttgaagaaatttaatcttacctacaaaaggcaaagcaatatgagatattaaaatataattgtaattccctaatatctgtaaaagcaacaggtgctatgacatttcataaatgggggaggctttgtgaagcttatgtaatttgaaatacaaataagattgcgaaagaagaaatgagcagcatctgcaggtcttaacattgctatggcaagaagacaagaataatagaagtttcaaattcaagttgttttggaaacagtttagtcaaccttacatctcatgtcataggaattgtttaaaataattcagctagttagcttaagtcttttctttttttttttattatactttaagttttagggtacaggtgcacaatgtgcaggttagttacatatgtatacatgtgccatgttggtgtgctgcacccattaactagtcatttaacattagttatatctcctaatgctatccctccccaatccctccaccccacaacaggccccagtgggtgatgttccccttcctgtgtccatgtattctcgttgttcaattcccacctatgagttagaacatgcggtgtttggttttttgtccttgtgatagtttgctgagaatgatgatttccagcttcatccatgtccctacaaaggacatgaactcatcattttttatgactgcatagtattccatggtgtgtatgtgccacattttcttaatccagtctatcattgttggacatttgggttggttccaagtctttgctattgtgaatagtgccacaataaacatatgtgtgcatgtgtctttatagcagcatgatttataatcccttgggtatataccccgtaatggaacggctgggtcaaatggtatttctagttctagatccctgaggaatcgccacactgacttccacaatggttgaactagtttacactcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatttcttcatgtgtcttttggctgcataaatgtcttcttttgagaagtgtctgttcatatccttcacccactttttgttggggttgtttttttcttgtaaatttgtttcagttcattgtagattctagatattagccctttgccagatgactagattacaaaaattttcttccattctttaggttgcctgttcactctgatggtagtttcttttgctgtgcagaagctgtttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagagatccagtttcagctttctacatatggctaaccagttttcccagcaccatttattaaatagggaatcctttccccatttcttgtttttgtcaggtttgtcaaagagacaagatggccgaataggaacagctccagtctacagctcccagtgtgagcgaggcagaagacgggtgatttctgcatttccaactgaggtaccgggttcatctcactggggagtgtcggaaagtgggtgcaggacagtgggtgcagcacaccgagcatgagccgaagcagggcgaggcatcgcctcacccgggaagtacaaggggtcagggaatttcctttcctagtcaaagaaaggggtgacagacagcacctggaaaatcgggtcactcccaccctaatactgcacttttccaatggtcttggcaaacggcacaccaggagattataacccgcacctggctcggagggtcccatgcccatgaagcctcgctcattgctagcacagcagtctgagatcaaactgcaaggcggcagcgaggctgggggaggggcgcccgccattgctcaggcctgagtaggtaaacaaagctgctgggaagctcgaactgggtggagcccaccgcagctcaaggaggcctgccagcctctgtagactccacctctgggggcagggcatagccaaacaaaaggcagccaaaacctctgcagacttaactgtccctgtctgacagctttgaagagagtagtggttctcccagtacgcagctggagatctgagaatggacagactgcctcctcaagtgggtccctgacccctgagtagactaactgggaggcacccccgagtaggggcagactgacacctcacactgccaggtactcctctgagacaaaacttccagaggaatgatcaggtagcaacatttgctgttcaccaatatccactgttctgcagcctccgctgctgaatacccaggcaaacatggtctggagtggacctccagcaaactccaacagacttgcagctgagggtcctgactgttagaaggaaaactaacaaacagaaaggacatccacaccaaaacaccatctgtatgccaccatcatcaaagaccaaaggtagataaaaccacaaagatggggaaaaaacagcagaaaaagtggaaactctaaaagtcagagtgcctctcctcctccaaaggaacacagctcttcaccagcaacggaacaaagctagatggagaatgactttgacgagttgagagaagaaggcttcagacgatcaaactactctgagctaaaggaggaagttcgaacccatggcaaagaagttaaaaaccttgaaaaaaaattagacgaatggctaactagaataaccaatgcagagaagtccttaaaggacctgatggagctgaaaactacggcacgagaactacctgacgaatacacaagcctcagtagctgattcaatcaactggaagaaaaggtatcagtgatggaagatcaaatgaatgaaatgaagtgagaagagaactttagagaaaaaagaataaaaagaaacgaacaaagcctccaagaaatatgggactatgtgaaaagaccaaatctacatctgattggtgtacctgaaagtgatggggagaatggaaccaagttggaaaacactctgcaggatattatccaggagaacttccccaatctagcaaggcaggccaacattcaaattcaggaaatacagagaatgccacaaagacactcctcgagaagagcaactccaagacacataattgtcagattcaccaaagttgaaatgaaggaaaaaatgttaagggcagccagagagaaaggttgggttatccacaaagggaagcccatcagactaacagctgatctcttggcagaaactctacaagtcttttcaattcatcatgctgcccacaatatgctatagaagattagcagttaaagttggacaggtaaaatatgcctagatttttgcttggatttaatcttatcattggaatttgctataggcttttagaaataatagggacatgagaattggagtattttaagaaaactataattgttcctaaaagggtttaagacaaatggagattactgataaaatattaattagtttttgaatgacccaggcatgagcttatggagaactagaactaggtaagtattaattaactcttgccctaccctaatggaagaatcatgggaaggaggtgcaagacaccagaggtggccagcatataaagtcctaggatcaaatttaaattccacatttgtccttcaagttgcctgcttaggtcttgtccaagtgtacttttctttctttctttcctgttctaaagctctgaaacttgcttcaatctctttttctgccttatacccctcagttgaatctttttcttctgaggaggcaagaattgaggttgctgcagacccatatggaagattcagtgaggtgagtttgctttgtgcagaaaggggatgcttagcataatagtataaatgctaagtataaatatttatatttcatataaccactgaatatttaagaggagatattgtaactgacccaatagtttcatagacaggattttgtttgtctgctttttttttttttttttttttaataaacagatattgacctttctggtctgaaagattgaaacttacatttgttttatctgagtaccttcttcaactgtaaccgcagggcctctcaaaaagtatcaaaaaactgaaactcatcagattatagcatccagacaatgagatgtccctcatttgtcatgattgcttccttactctacccaagttcctgttttctcatacatagtttcatttcttccctgctatataaatccccaatttcaattggtcaggcagatggatttgagactgatttccctctcctcatctgaagcactgattaagccattcttccttggcaaaaatcattgtctcactaatcagctttctgtgtggctagcagcaggacccagatggtacccctgctgtatcagtaacaatgtcaactagaaagttcaacacaagagtctttgcttcaggaggtctagtagtatttgaaaaatgagccaagagatacataaacatataaaagctactgaatgcataggacaagaataaatctgatagaaaattataaattaaaaaaattatagactgatccccagtcttggaaagggaaaagaaaatgggaatgcaaaagtgtatcagaatctaagtaaagaaagtatttcaagggacagggagtggttaactatgcctaaaaatggccaggccactgtgtaagatgatccgaaaggcaatcattttatttgggaaaatggaagacttttgcaattttactatcagtcaactggtgaaagactctttggagtgaattaagaataggaggagacctgaggacatgcagatagcaagtatacacattttaaaaatagtttagctaggctgggcacagtggctcacacctgcaatcccagcactttgggaggctgaggtgggcggatcacctgaggtcaggagttcaagaccagcctcaacatggagaaaccccgtctctactaaaaatacaaaattagctgggcgtggcggtgcatgcctgtaatcccagctactcaggaggctgaggcaggagaattgcttgaacctgggaggcagaggttgaggtgagccgagattgcaccattgcactccagcctgggcaacaagagcaaaactccgtctcaaaaaaaaaaaaaaaaaaaaaaaaaaaaaaaaaaaaaagtttagctaagaagagaaaaacagaaaatgtaaagaactagagaaggatataagaaatcagatttttgaaagatggttaatggtataagtttgttttaggctaaaacagataatccaataaagagtgaaagacagatggagctggagagttaatttgagtgaaacattgtggggtccaaagcacaaatggagtggtatctgcccttctcggtgacagtaagaattgtttaattgtttatccattatatgtgaaaagaagccagaggatactatgagtacagatactagtgaggagtcattttcaccatgttggtacaatttcatattctaatttgattatttctgttttcttactaaaaggaagccaatgaagaaggaagcaaatatagaggaggaaaggggataaaaggaagaataatctcagaaaaggaagatagagatgctggtaagcaaaaaaagagattacctattacacatagaagtaatttgtacattattttcgagaagaaataaagttttccaaaattgattaaaagaaaacacaactttcaaatactaataaattagtcaaaaacacaaaattttatgtttctatttttatatcaatgtttccatggagttaaatggatatagctaatttatacaatcttaaaaaaaagaagattagttttactggtagctgacttcattaaaatattcttcttaagccatttgggaggcaaacctctaggtaatattacaggatgttaaagtcatttaaatacaaataacgtatgccatatttgcatttaacaagttaacccaagttcatcctacctgtagggcttttaaaatgttataaaaagaatagataagcaaaatctttctttaagtattatacttcaattctcaaaacttaatgtgaaatgtggaaagacaaatgccttttctttgatctcggttggaattttgggctgaaatccatatttgtacctgatctgtgaactgtgtcttgtataatgaacagattcatggtgaaatcctttgggcttgttagctttttttctattgaatagtgatgcttctggggtaatgtgatggtccacaaacaccaacactaaaaatgaaatttttagatggctaaaaaacaagaaacagaacagtgaaatagtatacctggccatgttattctttccatgcaacaaatcaaaattctttaggcttcatttaaagcagcaaaaggcagcctgattaattcaatgtatgcctcaatgatcctcagccaaactcatggttgtgacatatgaaatataattggtatgagttgaaatagcctgtcttctttcagtctttcataataatcctactgtgttaaggctaacatttcttcataataatatcccattgattggtgaaattttgtacatgaggaaaaaaggggcatgaaatttagggcacagccatcatgtgtggccattcttgtactgttgtttgagtgatgttaaaagggtaatctgtcttgaaaacatttgatgtctcaggtgaacgcctgctacccccagattcactatgttataccaatgtattagcatgtatttgtgtattgcatctccagaaagccaccactgaaatgttaacctgttcatcagtgacactattaaacaaatacatccatataattatataaacttagaggaaatgggtcaagaataacccattttgatctcccgagaatcattcttggaaggttccttagatgactattcttaatttcaaaagttcaaacaaattttgaaacctctattcccgaaagaacaaatctgagatgggtaataagtttttctaaatcatatttaaaaagtaaattctagacttatatccagaaactatgtgtgtcttacgtcattcactattagattgtctgttattcccttggagtcaatgattaaaagccaattgttattgcactaacaacgaaggaaaacttggtcctcagaaagccaaaaacaaacataacaaatatggaaagcctctaatttctgcatgtcatctcaaattccatttcactgctgggagaaagaaagaaagagaagaagagaaaaacaaagaagggagggagggagggaaaaaggaagggagggagggaaagagataaaggaaaggaaaggaggagaggagagaagagaagagaaataaaaaagaaaagaaaagaaagatgaaggaaggagtgtgaggagaggagatggggggagggagggagggaaagggagtgagaaagaaaaaaggaaggaaaacaaaaggaagaaagaaagaaaggaaaggaaggaaggaagtgatatgggaggggggcaaagaagtcctgggtagagaagggcaggtccttggtgagggcttcacacctgggcctatgcccatggatctagtgacgacaggcatttctgtttttgtgcctaaatgttgcatttcctaagaccaccctggcccaccatgctttcatcctgtgcttataaaaacactgagaccctagcgggcagagacacacaggcggctggatgctgagaggaacacatcagcagaggaacgcataagcggctgaatattgagaagaacacatcggtggaagagtacactaacaggcaccagcagatgccggcaggccatcgaccagcagaacaatgcagagtttggccaggatgttctaaggagagcccggccactgagcagcccgactccagggaaaaaccaccttcccactgcatctcccttctggcttcccaatctgctgagagctactttcactcaacaaaaccttgcgctcattctccaagcccatgtgtggcctgattcttctggtacaccaagacaagaaatcctggggaacagaaagctctctgaccttgcaataagacagagggtctaattgaattcactaacacaagctgcctataaatggctaaactgaaagagcacactctaacacacgcccattgggacttcagctgtaaacattcacccctagatgctgctttggggtcagagccccacagcctgcccatctgcatgctcccctagaggtttgaacagtggggcaccaaataagtgagccacatcccatcacatgccctgtgatggggatgaggcaacttttcctgtttcgactgggtctcatccgggatcctggaaggtgaatacaaatgtgaaactatagaatcagtctctgttgtaaaaccctggcacttctctctttttcctgcaggtaagaggctctctttcccttcacgaagttttaaaccatcctaaccggtctggtaaaaactcccagacttcacctcttttctctcttttatggtttgaaatggcttttatctcttcctttacaatgttaagggatttgctacaggctgtggcaatgttactaggtaaaatgagcatttcgctcagcagccaagggtgcaaatcagaccacctatgcctagaggtgccacctatgcctccaccccaacagccgcaggcatgcatgactcagggcatctcacctttccctttcccttcccagttcaggtgcctgggcttgtgcacaacttgcaaagctcgcacccagcagccacgagggggagagggagaaagccctggtggtagccacaaccccaaagggccaatagacgggctcttctcacccaccaggccaacagaatgtttctccactgggggaaggatgtaaggattagagggactcacttgcactgaggaagaggctctttccccaggatctcccccttttgctctttaaactgtattttttaatttattttattttattattttatttttttgagacggagtctcactctgtcgtctgggctggagtgcagtggtgcgatctcggctcactgcaagctctgcctcgtgggttcacgccgttctcctgcctcagcctcccaagtagctgggactacaggcacctgccaccacgcccggctaattttttgtatttttagtaaagacggggtttcatcgtgtttgccaggatggtctcgatctccggacctcgtgattcgcccgcctcggcctcccaaagtgctgggattacaggcctgagccaccgccccgggcctgtttttccttttctaagtgagggggctccccactcccagcactgtttctgattgggaaattaatgcaggagtgacccctgctggctgataactgcaaattcgtcagggcttatttgagacactctaaatggataaaaacagcccctaaaataccttttcaatccgaagctcgattccaagcttctttttaagggtaaggccctagaaagaacaaccaggtctgaggcatccaaagccaggccacaggcacaatataaatgggcaagaccaattcttgccgattaaaccccacccccaaccccacagaaggaggccttgcttcatggcataaacaggcccagggaactcacaggttgttggcagcaggaaaaacaggaggcataggtgaggccggtcaattcctattctccaggttttccctgcttcatgggtacgtatcacatcagtacttatggccagcacctgccaaggttgccaggcctcagggatgccaggtggaagggatagggaggacgcttgctttatctctttatcacaccctgggttttcactgaaagaaagaaggaaatgagggacgcctctattccctgtctttcagaatcagtaaccagttctcttcaccacccccagcttatactcctccggagtgtgtcctgaaccactgggactgttttgaccctcaaaatctgaaggaaaaactcctcatagccttctgcacaaaggtttggccaattatgatttacagcaaggaattgcttggcctcaggaaggaaccattcattttgagaccctttggcagctggaacttttctatacatgtgaagacagatggtctgaggccccatatgtgcaggctttctatactttgcaaggcaatccagacctttgccaacagtgtaagattgacccagccctcctgtttgctgtctcagggaaggctgcaaggggcaagcccagggaattaaagatacaaatccgaggcactcccagttgagaagccagctcccaccagccctgctcctctgggtccaccctgacttccctatccactttcagcttctcacttgccccctcctagaaatcctcaccctaaagaagccccagtctcactcttgcccctccaacagatgcccagtaaatttgggaccagtaagttccaggtcctcttctcccaatagtacttaaagcaaatcaagggggatcttggtaagtttccggatgaccatgatagatacagagacgatatattgtgatagatatagagatgtatctctatgatatatatatatatatagacatagagatatatctctataatagatatagggatagatatattgggtgaaattctggaatttcacccaaatatttgaaatctcctggggagacgttatgtcatttttgaatcagaccctgatggacaatgagaagcagtacactctgcaagcagcagagagatttggggatgcactttgcatcacatatagcatcagggaagggggcaaatattatgcaactggaagataagcagaaccagtgaatgactctaaatgggatcccagtgacaagaaggaagacactttcaggtgtttataatggagggcttgcacaggactaagaccaagccactcagttaggctaagttgttcattatcgaccagggatttgctgaaaaccccactgccttcctggaaaagctaagagaggccttggtaaaacacacctctctatctcgtgattcagtcaagaaacagctaatcctaaaggatacatgcattactcaggcagcccctcatatcaggaggaagttccagaaatggccctgggaccagatatacattagagagcctcctgaagtggccacttcagttttgtacaatagagaaatgcagacccaagaaagaggcagaagctttaacgaccatcctgcaagccctcaaacagggtgcacctattaactgctaaagatacggcaaaaacagttagctgtcttctaaagtttaaccactcccatagaaggtttaatacctttcaccagggtgaaacacctcagggtacaatgttgctgttactatatttcacttcttgtctctgtaatctttggcactaaattctttccttgtataatacacatgtttaactcatgcatacttaaccttataaaactttttttttttcttctcatgcctagaagccataaaactccaaatggccaggcaattggagccttggatgatagctcctgtttgctagaaacccttagatagacccctgggaggaatctcactgctgttctccccaaaacaacaccccctgtcaccaggaagtagcttaagactagtcatcatccatattttaacagcagttagatgtacctcttcagaggggggagatgacacaggaggggagcatgggtagagaaaggcaggtccctcgtgagggctcccatgggcctgtgcccatggacctaggtgaggacaggcatttctgtttttgttcctaaatgttgcatttcctaagaccaacctggcttgccacaccccatcctgtacctgtaaaaaccctgagacccttgcgggcagagattcacaagcagctggaggtcgagaggaacacatcagaggaagaacacgcgagtggttgaacatcaagaggaacacactggcagaaaagcacactgacaggtactggcagatgcaggcaggtcatcgaccagcagaaccacacagagtctggccaaggtggtcagaggagaccccagccactaagcggcctactccaggggaaaaccacctctgttcttgcaataaggcagaggatctaattgagatgactaacacaagccgcctatagatggctaaactgaaagagcacattctaacacatgcccactggggcttcagctgttaacatttacccctagatgctgccatggggttggaaccctacagcctggttgcttcccctagaggtttgagcagcggggcaccacagatgcaagctgcactaccatcgcatgcactgtgaggaggacagaggaacttttcccatttcaaaaggaaggaagaataaaggaaggcagggagggggagggtaggagaaggagagacagaggggagaaacaaaaaaagaaagaaatgtatacacatacacacacacatatatacatatgtataggcattgttaaagatatacatatatctacttttctctgtttatctaactattatctatctatccatatatctatctttaatgttgaacctctaaagatgaatccttagatgtgtcattgaagcatttaccttagtgaacagcattgcaatttcagataattgtttcatgtaattattgtgttaactaaattaaactttcaattaatttttgacatttaagagaagtgtatgtcagcaaaattaagtgcaggttagccaaactaggattataaaaaccaatttgtcctttttatcaactttttatttcacattacacaaaattcatgttaggtgcttttgtggagtggttttccaaataaggtggtgggagaggaaaagttgtctttggtttcctacagtaaagtagcctataacaatgtcccttttcatatttattcaaatgcatgtttttcttattcaaaaaatgtcaaacaatatgtttcaaaaatggttatgacttcctgccttcttgtttgggcaaatacaaataaaacatctaaatttaagaaataggattgcagtatctaaaacaagttggacaatgaatagaggtttttgggatttcctttgggggaatggaggaagaaagtatgagacaggttccacagaaatcaatgcctaaaaatatattggtgtcccagacacaattgaaatatagttgtccaattgtcatgtctcactcatccttaaaaaaataaagcaaacttcaagtttaatcctttttattgtgtctgaaattgattatggaacaactgaataactatgtgctagcttgcgtattgttgtcgtgcactgaaagcatttcattgttataactctccctcaaagtatcaattaagtatcacaaaagtaataaagtaattactacttctgtgctatttgtattaattacaattattagtactgctttagtcactttactctcacagttacccgttgagttatgtactatatcattttacttacaagcttagagagaataaatgatttgctcaaattctgctagacactaagtggtggagcttgaattcaaacatagtaatatctgactccagccttctcactcccaccaaccccacatatgtacacaaaaacacaaatacatacacacaaaatcacataccaaaatatttttaacatacagatttatgagataatatggattaattctcaacatatccaaagtgatttcagtaaattgccatcttaaaatattaggactttaacatatagttcatattgttgacaatggttgctttcaaggaaattagcatatatggaggactggtgatgaagagtatgttcaccttttactgtattaaattcttctacagttcttgaacattttatagtgaatatatatttaattgttacttatgtaaaacaaacataaaacaaatttttaatataaaaaactataagaagttttgatgtgtcagtgacctaagattttggaattataagtcactaaaattgaatctaatacacagttggcatagtgtttgcaagttgaaacctagccatctctggaaatataccagaattcattactgaagtgaaaaattttaatagtgactagatatcaagatctcattttttcttactattatggaaagaaataaaagtagattagatgggagacaaaatctacttaaaatccagcagacatcaaaaacttaatacaccatgattaagtaggattaattcctggaatccaaggctggtccaacatatgcaaatcaataaatgtgattcaccacataaacagaattaaaagcaaaaaccgtatgatcacctcaatagattcagaaaaagctttcaacataatccaacatctcttcatgataaccacaatcaaccaaccggacattgaaggaacctaccccaaaataagaacaatctatgacaaacctgcagccaacaccatatggaatgggcaaaagctggaaacattacctttgagaactggaaaaccacaaggatgcccactctcgcccctcctatttaacatagtattagaagtcctagacagagcaatcaggcaagagaaagaaaaaaaaaggcattcaaataggaaaataagtcaaactaactctcttcactaaacatttgactccatacctagaaaaatcctaatgaccccatcaaaatgctgctagaatggataaaagattttagtaaggtttcaggatacaaaagcaacatacaaaaatctgtagcatttctatacaccaataatgttcaggctgagaggcaaatcaagaacatgatcccatttacaatagctaaaaataaaataaaacatctagaaatacagctaaccaaggaggtgaaagatctctacaagtagaactgcaagacacagctgaaaaaaaccacagacaaaacaaagaaaagggaaaacattttatgttcgtggattggaagaattaatattgttacaatggccatactgtccaaagtgattttacagattcaatgctattcctatcaaactaccaatatcatttttcacagttagaaaaaaaaattctaaaattcatctggaaccaaaaaagagcccaaatagacaaagcaatcctaagcaaaatgaacaaagctgcagacatcacatttcccagtgtcaaactacactataaggctatagtaaccaaaacagcatgatactggtataaaaataagacacatagaccaatggagcagaataaaaaacttggaaataaagttgaacagttacaactatcagatctttcacaagcctgacaaaaacaagcaatgaggaaaggaacctctattcaataaatggtcctgggttataactggctagccatatgcacaagaatgaacctgaccccttaccttttaccatatacaaaaattaactcaagatgaataaaacatttaagtgcaaggcctcaaatcctataacaaccctagaagaaaaccttggaaatacccttctgaacattggctttggcaaagagtttgtgactaagtccccaaaagcaattggaacaaaaacaaaacaattgacaatgagacctaattaaactaaagagtgtctgcacagaaaaagaaaatatcatacagtagaccgacaacctaccaaatgggagaaaatattcacaaactatgcatctggcaacggtctaatatccagaatctgtaaggaacttaaacaaaacaaaatgaaaaaaaaaaccaaataactccatttaaaaaatgggcaaaggatatgaacagacacttcgcaaaagaagacttacaagcagccaatgaacttgaaaaaaatgtccaccatcactaattatcagagaaatgtaaatcaaaaccacagtgaggtaccatctcacaccagtcagaatggctattgttaaaaaaataaaaaaacaacagatgctgatgacactgcagagaaaagggaatgcttatacactgttggtgagaatgcaagtttgttcagccactgtggaaagcagtgtggagatttctcaaagagcttagaaccccattctactctacaatcccactactgagtatgtacccaaaggaaaatagatcattatattaaaaagacccatgcactcacatgttcattgctatactattcacaataagaaagatgtggaatcaacctaggtgcccatcagtggtagagtgaataaagaaaatatggtacacgtacaccatggaacactgtgcagccataaaaaagaatgaaatcatgtgcttcacggtgatatggatggctctggaggccataatcctaagcaaattaacacaagaacagaaaaccaaataccacatgttttcattcataagtgggagctgaacactgagcacacatggacataaacatgggaacagacactggtcactaatagagaggaaagggagagaggtgggcagggggtgaaaaacttcctgttggttactatgtttcatacctggatgcaatatatccatgcaacaaacctacccatgaacctcctgtttctaaaatataagttgaattttaaaaaagacaaaaagaaaaatctaattaaaaatattttaaaaataatttctccaattacattttcaggtaccttcatgaattaacttattactttttgccatagagaaaaaaaggatttttttctctgatggttgaaaaagggtagttttacatcttctctaatcagatatgttcttaaattgaaaagagaaagggctatgagcaatgaacaaaaataaacattgcaaaggtgctttacaaaatttgctattttgctatcaacattttcatatttaattaaaaagactagtggaccacacaatttattgtttgtagcttccagcaaatacgggacagcaactgggaaggaaatagattattttgagtgtcaggatcagacagattgaagcagtggtcactcctgtactcatcagcattgtcctcttcctacctttcccaaacactgtggtactaggtcttggtactctggcctctaccttcctcacctgggaaggctttttctaaagctcagacctccccatctccaagcagcttcccgaaactgacctttctaaattgcctatcaaacattttcccacaagagatgcaaattttcattcactaattttgcaaatatgaactaagcatctcttataaaatgttttctaagagaaaacatggataaaaacctaccatttagacaggagtgacatatggtatttatctagaataaagaatttatctagacttattatgcagtaataacacctgctgcctgaaacagagaacgaaaataagccacgagtttgaggaaataaatatacctatgtgttttttctatataccattccttatacaagagtagcacataagaatagtagggaacttaataattatccagaagcttatgccaattagaggactaaatgaaataatgttttgaatatttcaatctgaaagtgaagaaaagaacaatcaggattgaaaacaaaacaactaagatttttttttagaatatggttaagttgaaatgacatattaaattcttacgttgcctttcataataactcattccagagttcaaagttgaatatttttattgtgccttattttatttttatttatttatatttatatttatttaattttattttcttatttattttattttattttgagatggtgtctcattctgtcacccaggctgtagtgcagtgacgcgatctcggctcactgcaacccctgcctcctgggttcaagcgattctcctgcctacggacacacaccaccacacccggctaatttttcgtattgttagtagagacgtggttttaccataccggccaggctggtcttgaactcctgatctcaagtaatctgcccgcccacctcggcctcccaaagtattgggattacaggtgtgagcttctgcgcctggcctatcatgtcttattttaaaataagaattcagtctaagaattagaaggcaagatgaggttggacagttaaggacattaaagaaaaaggaagttttatgctttccctcttttttgctttacttggatggatttttctactcacaattccttctccccccagcctgtctaatgcattatatactttgagatgtagcttatttcttgtttcaactcccaaaatactccgaacatatctttactgtgtacttaacaacactctattaaagcgatgtgctgtgtgtctctgtctcccctatgagactatgaaactgtgaaaaacgaaggcagaaatcttgtttattcatttttataagcccaagcagattgttgcactgtgcctggtgatactgatttcaaagttgaatgaaaaactgtgaaagaatgttcctggcatagtgcatgtatcatatgatgtgtaagtttatttcaacttagagtgagatagtttttattactctcattttataattagaaaaataatactaaaataaatcaatgacttaatttttttacacaagagtaagtggttgaacaaagatttaaattctgggtaatatgattccaaaacaagtgtcatttcaacatcttactatgcctgctctaaaagaaaaatgaatgaaacacctcttacctagactttggtcaggcaatggccatttattattactgcttgcctttgatttgtcaagtgtcttaatataggaggtaattaagaagctattatctcctatacaaagtttaagaaactattataactggtagaatgatgacgaattccacaaactagaagggtgtatgtggtgggtgggttggtgggcaagggggtgtgtgtgactgatgtatgttaacatttctatatatagatatgtacctaagtaacaaaacaaattattttaaagctgctaagttattatcactgcttgggacatctactcactatgtgaatttacgctttctgttagaactttccttatatatcagtcacccaaatttaatttatagagagatgtagagaaattaactcagtattctgaagagctgtgtatattctcacgtacttgaggaagaagaaaatcacttgccaaataagcatataacctattatatttttagaaaattcacaaacaatttgaaacaacgatttggaaagtataagaatccaggctcaataacaaattagttaagtgtaaaagttaacacctcccacacacacacacataaatacaaggccatccatgtaaaattaatgcacaatgtgtatgtacacatgtatgtatgtatgtgtgtgtgtgcatatgcagacagtctttctgagttatgtagtcctcattattacagaatttcctctttttgtcagaaaactcccaagaacatttgttctagttggtttgtatactgagccaaaacttatgcattggaaatgaatcatgacagatgctgaaatctcaacttgccaacacatttgaaacagggtgtcctccctcagcaatactgattgaatagaccccagagagattccacaaatacaccacaggtgattatgatgcatggaattagcagaatacctcaggatagtgaatactgcctaaatagtgaggtgttttttgtttatttgtttgtttgttttggtcattaaagcatactctccctacacatttaactgaagaggaaatgatattttctctctagcaaacctgtcccctgatttgtctacatatctttcccaatgggaactaaccttaagagaaagcatagggtgtcccattctcctagatttctgttattgcctgatgactccattttattcattcatcaacctgtctggaagctgtttactcttctctcctgcttctgtccaggaaccttagtcatcactaaaactaacagcttaccacttttttccaaacctgcttttcttataccgtgtattaaaagcagtggtccccaacctttttgacaccaggaacctgtttcatggaagacaaattttccatggcggaggcaggggtggggactgtagggagggtgtgggtggttggtttcgggatgaaactgttccatctcacatcatcaggcattgtattctcataaggagcgtgacctagatcccttgcatgtgcagttcaaaatagggtccccgctcttaggacaatctaaaaccaccactgatatgacaggagccagagctcaggcagtaatgctcactggcctgttgctcacctcctgctgtgcgacccaagggtagggacccctgcattaaagctcagtccactaaaaaattatagagtcccatttcctgctgttttctctttttttcttaccatatttctgtgatgtttttattgaattactggtgtttttcaaactgatctttcaccattctaacatattctgacccctccataaaatgcctgataatatattttttcttcaattttgcaatctgtttaatggtattttttcaaatttattcattcataagaattatttatgttatagatgttactttcatcaatcataacttttgctaatgtcttctccttttttataacttctatttctactcccactttagtgtctcttgattattagaagttcctaaatttactgctgttgaatttatcaattgctccaggtatgatttgtactctttcccagatttaagaaattcttcccaatatctctattgcacatgtatcaatttgttcttctatagtgtcttctcgatgtgctatgggttttgttttttccactaaaatcttcaaattacataaaaatgattttttttcatcccagtgctatccttttgcactgatctacacgatctctatcatttatccgtacttataagaatttgggttggtatttgtatattcttttttgtttcattgaactttttaatttatctatacaataatttcacttagatgtaatcactatatctttattataaatcttgaaatcagtaggacttgtctctctttttttttttttcctgtagagtatttgtttcatttcactctctgaacttatttacatattgtagaatcaggttgtcaaaatccatgaaaagtcttttgggatttaaaagactagaattccattgactctattaatcaatttaaggcaagttgatgactacacaatatttattctttatttctacccaataatgaggtatataattataaatatttagctcttcttcaggtattttcaatgaagttttgtaatttattttcataaaatatatatttttctaggcatgttatcatatttttgatatgtataatgattcttatttacttaagtataaattctaactttagctggttagaaaatgatttttacatgttgatttttgcatttagtaacttaaaaaaattcgtattaattccataaatttgtctatgtgtttttttttagttttctacatcacgtgaaaataataaaaacgtaacttttttcttaaaagaacttacctttattccttacaaactcttaagattctctaatataatacgaaatagaagtagtgactatggacatccttgatttgttttggattataaagaaatactttcaatattttaccattaaatataatatttactgataggatcattgtgtacaggaatacatggactttatgaatttatggaattttcatagtatttctaatttgctaatttttttctaaatcatgaacatgtgtttatataattcaaaatattttaaaatttattgagtttattatattttattctcccttttttaatgcaatgaattactttaaacaatttttttacactaaagcaaacttaaattctggaattaaaaccaacaagtataccttttttataacttcttcattcaatatttttatattatcattagaaattttgcaagtgaatctgtgattttaatttcttgcatggtatttattataaaatttacctaatttttgtttgccccataaaatgagttgaggaaaatttattattttattattctcaggatcatttggtataaaattggacgcattatttccttaaatatataatatataatatgatttgtcttatgactagaaccttttacttactgttatgcatatgattcccataagttacccagattgggaaggtcctaggttcatttcttacttccaatgaactcagggctctcaaagcagaggataaagctttccaggttttgaaagaattctcagtatgatcgttggtctttaaagctttctttcttgagtgttcctgctttcactttgtttggaggatctacagatttcttaatgttatgttagctcttacatttatttaaaaagatatgttgtaaaatctcctacctagattagcattccagttcagagggtcattgagagtatctaatctgctatactatcacgacctatattttttctgatattacttgatattttacagtttgattaatatatatggtcttgatttccggttgaccatcagtaaataagagacaccaaaacagaaatctaagtttctttgcaacccagccagtctttttttcaggtagtttatgattagtatattaactgtatattaatttaaaagtatactcccttaaaaataaccctgtgattcattatctgttgaaaaagaggaatggtttctgaaatctatccacatttttcagtttgggcaagttagggctgttatacagtaggcacaccttagttcttgtaaatacttacaaaaattttttcttcctggattcattctgaaatatatcgcagagtagattcaagtagtgaaaaagaacctgtacaccactgtgataattcaccctgctttcctggaagcatacaaaactagtataatgacagactgctaaaaacagctaatgatctaagtttgttgttgttattatattccccaagatgtactgtaatgtagaactcgtctcagagcttgtcagctctgagatgatttttcttcactctactcaatatgtgcctataagcaacagctctattatgctgctaccattagcagagtaattaggaaagctatcatggtctcaaactctataagtgtttgagactccgcctcataaaatgtccattagaggacaaattaccacattttaaatagagaaaacaatatcttgaaatatgtcttttctgatccccactgccaatgtctcaggttttgtttactactgtttttcattattacagtcattaggactagctaagcttggaaggaatcatgttcagaatataatttttgagcattaactcaacattaaaaaaagccttgtggtacttgtctgaatggacagaaaaagatacatcataaactacatgtcaatgcagtcaaaggttatgaacagatatgttaatatgcggttgagattgcatttaacacgtatagtagcaatctccatggatagctttgctacttcaaaggaattaaacagaatagtcattttttgtctttttttgaaagggagagtaacatatcttttcatgaatattaaaaaaaagttaaaaacctaaagaatcttaagttgtgggtagacagtttatacatatatattaatttagattttcatgttttattgtaaataattattctattttccttttttgtctttcatatctgtttatattttcttttaaatagagacaaggtttctctcactatgttggtcaggctggttacgaactcctggcctcaagtgatcctcccgtctcggcctccaaaagtgctaggattacaggcatgagccaccacatctggccatatctgattttgatttacaaaattttaataagcttgttatgttcagacaatgatcagttttatccatatcaacagtaggattagcttcaataaataaagagctaaatagtaattaagataattcatttaaccagaatcagtaagaatttataatttggatggttcttatttgaaatatgcatttgtaaacttttaaagaatatttataaattgacaagacaaatgaaaaataccattgaatcagaggattatgttttgagagtttcttattcttaccttctctctctttcatttacaatttctcagacaggattctgtaattcctgacaaactgaaaagtacccagagtctgagctttcctgatagtgtacaaagcctcaggcaaacccacactctaaaacaggctgcttcaattttatactccatttaacacttcatttgattctcaaacttcattttagtctgcagtgttaacattccagcatttacgtgagttgggcaataggtgtggattcaatactcctgaaagatagtttgggcaaatctaagcttcgatgcccgagatgagtgagagccattccgtttacaactgtgaaaatcttacttgatttttaaaactaagaccataaagttacataaaagggagcctaacttcaaaaagaactgcaacttatactctgaaaataatgggagcatcactaataggtggtgcatagatcatctaattgatatgcgatctctgaggagttgtcagaaaaacagtctgtgtagtagatgtgcgtggaaattacacagatatttaaattcagaaaagtacagcaaggacacaaattttcagccttttttggaaaggagtgtgagctctgagagacaaatattggaaataaatattagatttcctttgaaatgaactttgagattctgactttgttctctcaggattgcttacatgtcttctgattaggctgacttgataagcgaccggcatacctacacagggtccacacttagaagagcctcatgcttagtttaatgctgtttcattgccatcttgaaattcttcagaattttttaacaagaagccccacatttgcattttgtattgggtcccagaaattatgtaatcagccttgtttctgctatataatacaaattgaacttaaaaatagcaatctccaaaacatcaatagaaagagatatcatttttccctggattggttgtacgattgacagaaatgggactacaataaggactgagcccatgagtgatcatattgaggtcctcatggctatttaggcttatcaaaacaaaatgctcagcaaatactgttcttcctattcaaaaccacagttttcgattttctatattaacttacagtttagttggtgagagatggcattttttaatattaggagcttttgaagttctgttttcttaaaaagtaaacataataatatccaccagcctatcagggttccacataacataagcaagatgatttattgctagacatttattttccaaaagtaagaattcaaatagcatctctttgccataaaagacaagcaggtgaacaaaagtaatagatgcagcccatttggcaaattgaaatttcatgatatagagagagctgggcaatctcctttggaagaaatgtgaattcagtcacatatgtcagtatctctcaattgcttggacaaagacaaaagctgtgctatggaaaggatggggttattttgattcttttttttttttttttttttttttttgagacggtgttttgctctgtgacccaggctggagtgcaagtagtgtgatctcagctcactgcaacctccgcctcccgggttcaagggattctctcgcctcagcctcctgagtagctgggattataggtatctgacactgcacccagctattttttttttttttttttttttttagtagagacagggttttaccaagttggtcaggctgctcttgaactcctgacctcaggtgatccacccccctcggcctcccaaagtgctgggattacaggcgtgagccaccgtgccaggcctgttgattctttataagctgtatttgttgaataatgttaaacagggagatgttgattatatctttatcacagtaatgatgatgttctatttttactgaatatactttctatgtagatagagtctagtaaaccgcattcacctagaagaactaaaactaagatttattttatctctctctagttaaattcacatttataaattgtccttttcatgaccacctcaatgttctgcttcaactcaatattaaaccatgtgctatgaaatattaatgagaaaagtcagatccatttatatttcatgctgaaatgtagccaattcttccatagtgataatacaattactgaactgattttgaagtgcataatggatttttaaaagttaacttatccataataggctgtagccagatgttatgtaagatactgatggagaaaaaagactctaatactatagcatattaacagtttagtaaaagaatatctgcaatgctatgcagccaataaatgtgtaaaaaatattattttcccccttatgtttgttttctgtagcatcacaaatgtagtttcttcttttatcccaagtaataggaagccactcagaaattcagaggtcaagtttagtgtagggcatgagaatttggaataataataacagaagaaaaataatttataatctgtcttcattttcttatttctcacttgctccactttattgcctccttcatcatttcaccacaggttttccaggggagctttagtaaactgtatactattaaatttcatgtttttttttaatctcacccctcattaccactatacaaataaaaacacattttttttttctttttctttttttaataaaactcttaccatctccgacatgagaatctctctttttctttctttgtcactggctatttctattcattttcataagcagattccgcctaccctttttattgaataaaggcttatttctgatcatttaactcttattttttcacagaaaattgtattcatcccagtgcttcacttatcatctatatgacaatgactcgcacatgtgtctccgcaccaatcatcatctccgtggatcaaatccatatattaacctggctcacaaaaacttaaattcttcaaagacagtgaaaacatatgaaaccaaacttctcactctacacaaaaagagtcctattccagaattttctcttttgataaatgccataactgtatgtccagttacagaaccctgtaatatgatatttattccttatactttctctccttctaaaacttttctaagttctatgattttgctccgaaatatttataaaaaagtctacacttcttctcagaaacaaactccttagtctaaattaccattatatctgacctggactaatgaaatagcttcataactattatatccatattgactttggctaacccttttccccagcgccaagaaagagcaatgttttaaaaatgcaaattcaatcacttaattcctctatttgaactatcaatagctacccgttattcctatggtcaagaccaagatccttaataataatactgtttgtaagactctgtacctcacttcctgacctctagccatgctgccctcctttagtgccttttagataccagactcttccacacactaagcctttgcatatgctggtttgtctatctgcagtacctgctctgccttctcatctctcattttcacctggttaactctctcttaatttccaaagctcagttcaaatatcattccttgatttaagacttcttcagttgctctactcatgactggatctattttacactgttattacactatgtcctcaaatttaagcactattcacagattgaattttacattaagttttaataatttggtgaatatatacacatatataaattatctttaataggtcaggctttctgagagtaaattcaattgcaacttatttgatgaagactttaattcaacagactttgttggattaaagtctccataaaagaagttacagtttatgtttatttacaaatataattttttgttcttataaatgattaagtaattaattaaaatgtttataagaataaattaattaactaatcaacatatgacagacaacttgcccaaactgtttagaaacatttcagtaagtttaagcgagagctttcaataatttcatcaatagatttgaaatcacctttgcaaaaattataactgagaaagttattgcagtgaaagagacctgacctaaccaaccccattttgcttctaatctccaagctgttcttgttcattcctgggtttaggcctaagtaacttttggaggaacttactttatagttgaactttgaaacaaagaaaataacagtattttcccaaaacaaacactcttcctgcctggggaccacactgcctttgcagggctaacaaattagccatgagattagaaattatggtttaggagtcatgcagctggaggctgtaagtttccaaacctccctaaattgctcctgggaataacatcagtattgtaaaacctaagatcagtgtttgagatatttcgcagaccctgcactggatgaatcagctggcaccacccagttcaataagctgttttatctggtctcgtggcccttacccaagaaatgactcagcgcacgaggacagcttcaactccctatgatttcatcttggacccaatcaaccagcacccttgactaaatggtgccttaaccaccaaagtatccttaaaaactctgatccctgaattcgtggggagactgatttgaataataacaaaactcacctctctggtacagccagctctgcatgaattaaactctttctctattgcaattcccctgtcttgataaattggctctgtcaaggcagcgggcaaggaaaacccactgggcagttacagacacagcttctttccttccttactacttttcttattactattcttccttttgtcctgtcttcctccattcttgcccacctgctttctatccagtcactattaagtacttggtatagagctttgtgcatcctagatgctcaaaaacctttgtaaaatgaattaatgaatcagaatatcaattttcatatggcttgtaacactttctagttatacaatgttaactaggttatgtttgccttctaatagtctgtcaaatagaataagaaatgcaacgtctactaaaagttgtttggaaactaagtggaaaaagaagaacaactcatagaaatactttttaaaattaaaaagttgttatagctgtcatcatcatttttgaatgtctattactatttgttctgtaaactatgcaaatcaaaattaagctctatacaatacatggctttgtatattacagtgctttagtattaaactcaatcttgactcttaagtcatttccatggagttctcttgtgaaacccagagatattgcaatggatgctttggttttcataaaattccacacaaatcccacataatacagactgctgtctatggttttctaacgaaaacatttcgttcttttgtgagttatgtgtcctttagatagctactcaggcctatgctattgaggttaaaggtcttcagagaatgcttctaagccttcgttaggacagttaaaggcagctatcccagtaaatcaggatggacagccgactgatagtatactcaatttaccttttagataaactacactgagagtaagttctcaacaggaaataaaggtgaatttcacaatgggtacaggccattccccagtgttttcacagggatttgaaaattaaaaaaataagtgagggtatgtatcactcagaatcagtgctgtattgctcaaaagaatgagttatggtcataaaggtacagtttatgcagaaactctgatataaaaaatgattctatgactctgacctttgcacttgttttctgcatattattttttctatttttcattgttacataccaataattgatttcagtcagtcactcaatctgtatttaccatagtaaaaattttagggcatattttctttactatcccactgtttgaatctctaacctgtcttttgcctttggacttaaatacttctatttaagttttcacgtcacatgtaaattaactgccacttggccagggaagtcagacatatatttatcatgggggagttacaagagcatcagaaatgaatgctaaaatcttggtgtgtatttttagaaccattatatggtttatgtagtgctaatgtttggcttcttctgaatattcatagggaatcagagtctagataaagaaaagaaatagtcaaagacggtataaacaacaaagggattctggttttgaagaaaaaagtaggggaagtgagatcgcttcaaattcttatttagagtatattaaatattaactatagttgaatagttttcttaatctctctgaagatattgagctttccatctatgttttctataattcttttatatggtaaatacaagtttaccatataaacttgtatttatatggtaaatacaagtttaccatataaacttgtatttatatggtaaatacaagtttaccatataaacttgtatttatatggtaaatataaatacaatatatttatttatacagtttctgcagacataaaatcgatttttaaaaatggtattcttccataacattatgaaccacacataaaatcaactaattttttaatatatatttaagaagtacttttatacacataggtacatatattattatgatttgtccaaattgtttttcagcatgcatattttatttaggaagatattgtgaatatattttccattaatgggcattaataacaaacatcattttctaggtttgatgatatttaacttagtaagtccccttttattagaactataggatgttcattttttttcttttttctttcttaatttatagacttcttttatgaaatctttgtttctacttaacatatttttttcttaggattaattcctatagctagcacttctgggtagtgaggtgaaatatgaaacgtaagttctcaacaaatgcttgttgagggaaaattttgaatgaacaaagaaataaatgattgtaagatgtggtacctccctggatttcatccccttctcaaagagttaatagaaaataagacacagtcatgacattaagatggttctggaatggcaagctatgactctgttttttattcaacatgaaatcatctagctgtgccaagcagcttcatttattaaaactgctttagtgaagcatatactgatatttaacctaaatttgagtacagatacacttgtgagaaaagaagttgtttcatttcttttgattttcgtgcattattcaaagatttaaacaataacagctgtgatgataaatctgaaatgttatgaacatgaaactctcattttaagattcacatgacaataagtaaagaacactcatataatacctacgcatgtttctttcttttccattaaaattatccaaactataaagaaaaatcggccttttaaaacttcacttgcaggctactattatgttacaatcattctttcttcatagaaaatgactgcattaaaaaaatactaagcaacaattacagttttctaaacagcatgctctgtattttatctaattgctaattcatataaattttactgtcagtccccttacaaagtatttgaatatgagaaatttttaaaactatatacctatacctgtttgtagctatatattgatttatatttctttgcagtacataagttattgtaatacagagtttaactttataatgaaaacctcattaggtttggtcatatctgtagctgtagtctatgagggttttttttttttggtctatgtaatttcttcattcattcagcaaatatttattgaatgccacctatgttgtccttgctgtaggtgctacaaatacaaggaaaacagcaggcaaaacatcaaacctgcaatttacacagatgtattttaaaacttggccaagtctgaggccaaaatgagcttcccatttgacctctgctgaattgaatttatcccatcagttatagcctttgcctatattttgcataatcaattttcatattgaaaagtcaggcttcttccatttccagtactcatgatgaaggatattcctctttgcatccttgcactttcttaagttttattatatatttcttttcatgcatttgtattagccaagtacagagttaatggacttactattttaggatccatttgttaaaatttcaattttcttttaaactctcaaatcacttttatgaattaaagctagcatatcattacttccttacttttgcctaaaatagggcattcatttattttatatttagaactcaaaagctttatttttcattaatacagacacacagtgctaattaataaaagctattgattacaatatcttaaatattcacaataagaaaaaaatcagtaacttcaagttgcctcagcacaaagtaatagagtcttgtgttgagaagaaggttctactcaaaagtctgtctcaagttgaagatgcaatgagtctgtaatcagtttgcttaaaggtcagccaatttaaaatttatgtgcaaattttacaacgagactttgttatattcacctacatagcccctgctcctataatatgcctaacatttaataagcattaaatattgtttaattaatgaataaatcattaaacttatatgagttggtaacctagccaatacgatcatgaaatgactgtcaattagtgatttgaaaagtgttatccttgggaaactatcttagtaaggctacacgttcctctttaatattcataaaaagaaaaggataatttcaccagcaggtggactatgttcaatgcctgagttgcattcagagtaagctagggcagtgacagtaagctttgagcactatgctagatgctgctctctctccaggtctaatgacaagtatgatctgaaaatattaagtcagcttttttcttgtgtagtgtgtgtgtatgtgtgtgttttaattttctttaattttctttctctttgatagttcaatggggaaaatactatacaaattagaaagggaagtgaattgtaaaatgtgcttagccgttaggacatgcaagaaaagtactggaatgcaaaatctcagagaccacatatcttccattccactattctcatatttcagccacaccaaattattattaatctttaaacaaccttcaagtctagcatcatgtttaggggtgtgaaaactagaacaaggctgagttcactcagctgggtcatttattaatcaaagtattgagatatatttaaaatgcaaattaatttatatatttgtaaatatgtgttgagtactgaatactgacacgatacttaatatatatatattaatttatatatatatgtgtaagattttctctaaaaatattcttctgtttttcacattgtaaaatgctactgacatcaatttttctgctttcatatgcccaggtatagagtaacggcacacgtaggctaacttgaagaaaaaaaaattgggagaaaaataatgctttaaaatttgtttatctagtatcgaatagacatgttcatattcaaaattaaacgtattgtaggatgtaagcatctgattttaaccacatagcaatctcaactaagcaaagtaaataaaactaaacccacatctaagcacatcagagaaaaactgaagaaacgtgaatcaaaagaaaatgtgtaagtacacaatgtggtattgctaactctaggtactgttgtgcagaggatctctagagcttattcatcttgcctaacagaaaccctgtatcttttaactaatatcttcctacttctccctcctccagcaaccaccagtctattctctgcctgtatgagtttaattaatgtattaaatagataactcacataagtggaaccatgtagtacttgttctattttaattggcttattccacttagcgaatgttttccaggttcatccatgtcgttacaaattgcaggatctcctttttggtaaataccgaataagatttcattgtatgtacataccacattttctttatccgtttatgtggatttgttttaaaaccttgactattgtgaataatgttgcaataaacattagagtgaggctatttcttccagcttatgacttcaattctattagatatatatatatatatatctagaacttggattggtggattatacagtaattctatttttaatttttttgaaaaaccaccaaattgtttcccatatccagggctttttggtcagctatttaaattttataatttgctatcatttctttaatcattctaaatatttacttaccaacataaaacataaagtaccaatcaaatgaaatgtcattatttgcaataattatctgttaatctacagctgcgtactaaagtctatcattgtattcttttctacaggagagaagacacctctgtatttgtaggctctccccacatcttgtgagtcactaaagaaaaaccagttgttccaattgttttaacaaaaccaggaactgagattctaaatttacatactctcataccattttatgtttatgagaaatacaaatctagaatgtggaagttaagaactgcctgtttaataaaatcatcttgaaacagaaagaaggcaggaagggaaaaaagaaagaaagaaggagacagaaaaagagaaagaaaacaaggaaagaaactaggaaaagaggaaggcaggaacaaaagaaggaatggaaggagagagtgaggaagggagggggagaggaaaagaaggaaagaagaaagaaaagtgttaaaaaaaagaccaaaggaagaagagagatgatctaaaaagaagaaaacattactctagagcttctcaaactggcatcttatggacccctaagaatttgtgcattttatatagggatccataaatttcctaaaattgtatccaaattgttccatttaattaatctatctatctaaatatctattgctatggtttgaatgtatcccccaacagttcatgtgttggaaacttaatcactattgtaacaatattaacaggtgggtcttttaagagatgatagggtcaccagggtggagctcttgtgaatggattaatatcatcatctagggtgtgagttctcttgggagtgaatcagttttcacgggactgagtgagttttcttgagagtgggttgtagtaaaagcaagctggctgcctctgtgatttcctttgcttgtgctcagcagttcttctgctcttctgtcataagaaaacataaagaagaccctcactagatacctgagtcatgttcttgaactccccagcctccagaactgtaataaataaatttttctttataaactacccagtctatgatattttgttatagcaacagaaaataaacaaaggcatctatcattgtattactagatataatatacataaattttatacaaaccgtacatgtttgtgtgaattgaattgtgtccctcaaggagatgggttgaagtcctaattctgatacctattaatgtctataaatgtgtatattcctatgtatgtattagagtaattaaatgtttaatacttttaatatcttaaacatcacagtgtgtattggggagggataatgtttagagatcacctctgctattgacaataaaggtattggggtgaagtgtcttcatattttctgtatgttttgcatactttaagtgtttcaaagttaaaacttaatgaatacacagcattttttattgtgttaaggaaagtgaaaatttgcttttattgggtaattttaatttggaccctaacttactaaataagagcatttccctgaccactttctgtatccaactccaacctctttaatatacataatacctaataccactgtatcattgcatttcatcttagcaagatgaaaatgggttctaagtatcttccagaagaaccaagttgacataagcttcaacacagactataatattttgtttcttattttttaggtgccaatacctccaaatagtgacagttacaataatatagaattagccatggaaatgaaaaatatagaacaaataatgggaaataaaattagaaaacaagaaaaggtatgttgaaagaaaaaaagatgggaggaggaaatttatctatatctctgattaatgtgtgtttaaagaacggtagattgttaacagttatgaaacgtccagaactgaaaaattctaagtgtcttccttaaattcccaacacaacatttttagccaaatgtgtaagtagtgatcttaagatttcataaatttcaaggataaaaattctggtgtttataatgacattcttattagaaaagaaaaataatcttttctgatgtttctctctttctctctttccccccggcccctcccaaatttcatgtcctcacatttcaaaaacaatcatgccttcccaacagttccccaaagtcttaactcatttcattaacttccctacaggagaaagttaagaaaatctgagaaaagcgttaagcaacacaagacaacacatacttaaaacttaatacaatgacaaccaaacatttcatctctggtttctctgctttagaaacacctgaatatatgattgaagcaaaggacaagtctttattcacagcttgtttatcagcattctaaaatctgtatattctattactatctgatgttaagccagagtttcaagaaaatacattcttaataatgtttaaaatgacaacagcacttctgttatacaatttaaaagatcaactgaaatgagaaatggaaagaatgttaattttgccaaaagattaaataagtgaaatccctggaatttttgaccaatagcagatgtctttactaagttaaagaaaagacaatgtaattcaatgaagaaaatttaccaagctctcagatgatgactgacttctttgaagtcacaaaagggaaaaagaacataagcttgttgtattagtccatttttacactgctggtaaagacatacctaagactgggcaatttacaaaataaaggagtttaatggacttacagtgccacatggctggggaagtctcatgatcatggcagaaggcaaggaagagggagtcatgtcttacatggatggcagcagacagagagagtttgtgcagggaaactgccccctataaaaccactagatcttgtgaagcttattcactatcacaagaacagtatgggaaagacctgcccacatgactcaattacctccaactgagtccttctcacaacacatgggaattcaagataagatttgggcaggaacacagccaaaccatattattcccccctagccccttccagatctcatgtcctcacatttcaaaaccaatcatgccttcccaacagtcccccaaagtcttaactcatttcagcattaactcacaagttcacagtccaaagtctcatctgagacaaggcaagtcccttctgcctataagccttaaaatcaaaagcaagttagttacttcctagatacaatgaggtaacaggcatttgggtaaatacacccatgtcaaataggagaaattggccaaaacaaaggggctacaggccccaagcaaatctaaaatccagcagggcagtcaaatcttattttatattttattttattttatttcatgttgttttttgagatggagtctcactcttgctacccaggctggagtgcaatggcatgatctcggctcactgctacctccatctcccgggttcaagcaattctccagcttcagctcctggagtagctgatataacaggtgctcgccaccacgaccggctaatttttgtatttttagtagagatgcagtttcaccatgttggccaggctggtctcgaaattctaacctcaggtgatctacccacctcggccttccaaagtgctgggattagaggtgtgagccaccacacccgtcccaggcagtcaaaccttaaagctcgaaaatgatctctttaactccatgtttcacatccaggtcacgctgaagcaagaggtcagctcccatggccttgggcagttctgcccctgtggctttgcagggtatattctcactcctggctgcttttatgggctggtgtttagtgtctgaagcttttccaggcaaacagtgcaagctgtaagtaaatctgcaattctggggtctggaggatggcagccctcttctcatagctccactggcagtgccccagtagggactctgtgtgggggctccgactccatatttcccttctgtactgccctagcagaggttctccatgagggccgggcccctgcagcaaacttctgcctgggcatccaggcatttccatacatcctctgaagtctaggggtagggtcccaaaccccaattcttgacttctttgcacccactggctccataccacatgggagctgccaaggcttgggttttgcactccctgaagccatggcttgagctctgtgttgacccctatcagccacagccagagaagctgtgacacagagcaccaagtcactaggttgcacatagcataaagatgctgggcctggcttacaaaaccattttgtcctcttaggcctcagggcctgtgatggatggggctgccatgaagaactttgacattgcctcagggacattttccccatttcttggggattaacattcaactccgtcttacttatgcaaatttctgcagcagacttgaatttctcctcagaaaatgggatattcttttctatcgcattgttaggctgcaaatttttcaaacttttatgctctgcttcccttataaaactgaatgcctttaacagcacccaagtcacatcttgaacactttgctgcttagaaatttcttcaaccagataccctaaatcatctctctcaggttcaaagttccacaaatctctagggcagaagcaaatgctgccagcctctttgctaaaacataacaagagttacctttgctccacttcccaacaagttcctcatcttcatctgtgaccacttcagcctggacttcattgtccatatcattttcagcattttgatcaaagccattcaactagtctctaggaagttccaaactttcccacatttccagtcttcttctgagccctccaagctgttcccatctctgcctgttacccagttccaaagtcgcttccacattttggggtatcttttcagcagcacccacttttctggtagcaatttaatgtattatttcatttccatactgctaataagacatgctcaagactgggcaatttacaaaataaagaagtttaatggacttaacagttccacatggctgaggaggtctcatagtcatggcagaaagcaagggggaggaagtcacatcttacatggatggcagcaggcaaagagagagcttgtgctgggaaactcccccttataaaaccaccagatatcatgatacttattcactataacaagaacaaaacaggaaaaacctgtccccatgattcaattacctcccactggctccttcccacaacacgtgggaattcacgatgagatttgggtagggacccagccataccatgtcaattcttattaatgctctggattgctcacggttagttatggttatgtatagctaggtgttgaactaaaaatgtcagaattagtggttaaatttcctggctttcatctgctaccactgtctctaacttcatactgaagtaatgatcccagggagatgttctgaagtaaatgttcttggtgaaggatgaagatgaatcaggggaaataattcaccattactggaaaatacttcactgttcttgactcagaaatgtattatttttgttattatgataatttattttgatatgttctgctcattaaatgtcctgttcatattaatctgtaaccaaatctctgtgataatgctttgcatataggagtccaatgtgttcatcattcccaataagcctatgaacatattgaatagtcagttatgtaaggacctgaactcaggaattgctcactctcacatataatgtacatattctggaccaaggttactgcatttcatatttgtcaattctgcatttgagtaatttccaaataataaaaatagcttagaactttaagtggcaagcagaacacatcaaaattcattatatttttccgtattaaaatttttctctgatctggttaaaaggtaaatagtacttttcctgagctatttttattaaaatattagtattacaagttccacctctttttagataatgctttcacttaaaggtgcttatccacattagctgctatttcaaaggctgaagactcttgaagtctgttttctgataacattcataagatagatataagaaagttttgtgtcaacatcatttaaaagaaaaatattgtatctaatttctaacataccactcctgtgtacatatgcaaaatctagtctcaattatactttctcccttttttattcctacttactgcttctcttcattttctaaaagtatttcaggtttaaaaatacatcaaaagcaaaaccagtttgaaactacagtttcagcattaaccttcacataacacagcaaggattcttccttgttatgatttcagccttgcgcacttccacaaatccatgcacagaaagtcaggctcaggccaaggatttctttcaatttgttgagagaaaccagcaatgtgattaataagaattatttaagtattgttgcaaggcaaggtgtcaaaaaataccatgctacaaacttcccgtgctctcgccttcatagaaaaaggagaaggaaatcttttgtattaggtaatgaaaaatgatttacctaaacatattctgggatgtccaatttctctctcactttgtgggactagcagtaagatgcatgctttcactccttcttttaacttatctccatagaatattatttgaggtaaaaagaaaactttatttttctttttattcacacaacacttctgacaccaaatgtgtgggatattttttttcccacaccaaccaattctccaactctctggacaccaatagagtgtcctaaaattcatgtctgacactaattacctagagttttagcacggacatcacaagttaagggctcagcctcacaacatttccccacacttcagacactaatcacaaaacatttccccacacttcagacactaatcacaagtcccaggtagtcacttgcactctaaccacctgtaaattaggggttcccacaaccctcttcttagatcttatactttgctgtaatgactcacgattcagggaaatactttcttattactggtttattatagaggatacaactcagaaaaaaatgaaaaataagtgatgcatggggcaaggtgtggattatggggtgtggagcttccatggtttttcaaggtgtgctaccctcccaacacctccattgttcaccaacccagaagctctgtgaacctcattgtttagaggttttatgaagttttcaccaaataggcatggatgagtaaatcattggcactttgtgactgaactcaatctgtagcccctctccttccctggagattgaaggatggtgctgaaagttccaaccctgtgataccatggttgctttctctgtcaatcaatgcccattctccaaaagtcatcttattagcataaccttggatgtggttaaagaaagcttattatgaacagcaaaagatgttcctttcacccgtatcacttagtaaattccaaaggtttttgaagctcttgtgttaggaacctgggacgaagaccaagtattataacaaaagattttcccattactcctattattcaggaagttataagggttttagaagctctgtaacaggagctgagggcagagactaaatctgtatattttattccgtcacagaagcattaatacattgatttgcagaacgctttcattgaaaacggacctgctttttaatttattttttttaaacttagacatagtaaaattcactttttctgtgtgtatagttccataaatcttgacaaacacattgtcacatcactaccatcatagtcaaaatacataattatttcatcaacaccccccaaaatcatctcatattgtccctttgtacctccttcaaatacaaaaacaaacactataagactaacttctgttgttctattttgtaattgtataattgtattttataatttttgtgggatgtactttacttttaaaaaaagtttgctgaagtaatcttattttttcaatgaatattaaatagctactacaaaccaggtactccataagtcatctgggacagagcagtaaatagaaaagccttatggtgtttacatatttcaatgggggaaaggatgagtagcaaaaaataagcattataaataagaacattatacagtatgttagaaaaaaaataccctaaagaaagaaaaaagaaagagagagattggaagtgataagctgaagataaatgattgcaaatttatatagggtgatcattaaaaaagtaattccatggttataaacattactcaaattccaaatctttacctgatgataatctggatttcataaaatctattttagtgaatttacattaaaatgtgtttaaatcagtcttaattgaattcacagaaccatgtcactgattttccttttctctatattacattgtttttatttgtaatttaagtccatctctttcatgtatttgaaaactgcagaggtaggaaataaatcttaaaatccatttgtaaaattataaatttttagaaaaatttggaaatatgtcatattttggttgtaatttaagcacatgaaattatatcttcattctctcaagactcaatttatatgactttaaatgattaaaaaatttattaattcatatgtatgaatgatgtcagcacatttcttaaagctggaaaactgaatactaaggtgtttgcctaaatgaaaccagcctatctgacctctaggaccctagtaaggggctggggcatgactgagaaaagaatgaaaaatgaacacaaatttacaaactaaatagttgcacagataaaattatgagattatctccttacttcctttagtaactccccacccactagcaatcatagatatttgctctccaagcaggagactggaggatcctttcctggtgaaactgaccattctagaagtaaagccctccacaatactaacatttgggagaggagatggagtggctcttaaagaaatgaatgaatttgctcctggtttttaaaagtgtaacttgttagtcaacaagccctgctcagccacacagagctcccggacagatttcaacacttcactcttacatgggaaaagatggccaggaatcattggattagagaaaaagcctttaatatccatgaacaagcccaaaatactcataaggagaaaaggggaataagaatgcatttaaacccaggattttcacaaagcacaatatacttcaaacagaaaaataatgtaaaaaaatattgatcattccatgcaattatgtttacaagattttaaatttaggaacagctaaccaatttgtttcttagaatcctcagctgcaggaatattccttgaaagaaaggacatatgaaagagtttctgtaggtaagtcctagattaaataggatttcacagattctgagcatggaagtgaacagatctaagttagtgaaaattgaactctgtaaatgaacaaaaccataaatctttcaatttgggagtacagttaatggaaagagaaactagtacttgaataccttatagaataccaactggatagtgtcgacttatttatttatttttttttttaaggaatttcactgtcacccaggctggagtgtagtggagtgatctgggctcactgcaacctccacctgccagttcaagtgattctcctgcctccacctcccgagtagctgggactaccagcgtgtgccaccacacctaacgaattttttctttttagtagagacggtttcaccacgtttgccaggctggtctccaactcctgacctcaggtgatctgcccaccttggcctcccaaagagctgggattacaggcatgagccaccgtgcccggcgatagtgtcgacttttatttgaaatacatatccaatgtctcaagtagcttctataattttctcataagtattagcttcaatgccatgtacctagaaggtccctctcaaaaatctcttttggactgcaatgagatggctacttacaacatagtatgcaggctaacagctgatttctaaaatattattacttcactgtatatctgaatctataatctgactttaatataattgattgaaatgaataatctatttttggtcctggtttcgtcccattttatgatttattccagactatacaaaagataggccctccttcatgatgaattgagacctgtggtaactttctcaactcttggacagatagaaataagatgtaacccatcaattctcatggaggtcattaaaatgaccattcaaagcacagcaaatgcaatgtgttgtggcttttttaattaaaggtgttacttgtcaacccatagataagtgagctatgccattactcctcttgcagatgagagtgaactccccacatcttacgttataagcctattttcataaattagataatcagaaaatgatgtctttcatgtacagcagtgttgacctggttaatagaattatatgcttccctaatatgcacataattcgggagggatctgaaattagtggaattttctaattcgccaagctttggcaaaatctttatctggcaataattggcctttaattagcaaattcatatacttttacagtttcaactctttcagatttcttacacttctcaatgagggatgtgacagacataaagaagaccttgatccaaatgctaatactcagaattggaccaacctccaataaaatatgacactcaagtccctagctaatttaagtattcaattataattgaaccaaatggcaacaggcaagaaagttttagagttcttcacaaggcagcattctcgccattaaaactcactaattacactggtcatactatatatgaagttgggttaacaatgaatggttaaagaacatgaatgcggcatgtcacataaagaatacagaattatataaacaacttataacatttttgtttattttctaagaatattctaaatgcattcgttttatcaatttcatattaataaatgcaatatatatagttagcaaatttgattagacaattctcacactgctttttaaaatacttattacagtctgtattgtatggtgacctgagactacattttaccacttccacttgttatccagagtttaccctacattagcctctgaaatattttattgttctccacagaaattgaaatccaaatttaacctactattctacagtgatatttttctttagaggccactgctcaaaatgaggtgcttgttttcagtacatacagacaccatctaaatggcttcctggatgatcttagccttcaacagaggtgatatgttgacatgcataccacacgaagacacgttatgcaagatgcactcatcaaagagatacaacctgtaggcacagtgagaatccaagacagaggaaaaggattctgaaaatcccgcatcattttctgtcaagcaatatacctctctacatgtcacaatgtcaatgatactttatagaagcataaggaaactctcgttaacaaaaaatcagcacattaaaaattggaaattcacccaatatttacatcaacattttcatattttatctaaataatgatgagatttttccgggaattcttaaaaaattaagctcaagtattacattcaaaattgattcaatttagaaaaacatgtataggaagcttatgagaaatttttatatcacacaacatgctgaacactgattagagccagtctgattttttaaatgagataactgtaacttcaaatgtcaatttaaaaaataatgcagacagatcttatctgccctttacccagtttggaccgaagacaacatattgcacaattttagaacaatattacaaccataatattgacattgatgtaggcatctatagaatattttcatcaacacaaatatctctcatggtgcccttttatagtcacatctacatggtatcataagttcttaaaacatgtaccttttgaaggacatctgtgtggtttctagattttggctattatgtataaagctaccataaacaaacatttgtgaacaggcttttgcattaacataaatttttatttctctaggataagtgcacaggagtgctgtaatgtatcatatgatagttgtatgtttaatttggcaacaaactgttcaaagtgttttccaagttggtaatgcaattttacattcccaccagcaatgtactgtgagtaaatttctctgaatccttcccagtgtttgctgttataattgttacttattgtatccattctgataggtgtgaagcgatgcctccttatggttttcacttgcatttccttaatggctaatgacatttaatgtattttcatgtgcttaattgcttatgacttctttggcaaattacctatttctgtatttttgccccattttctaattgttttttttttcttttttaaagttgcacattgaaaattatattctagatgttagccccttattgtatgtgtggtttgcaaatattttctcccagtcttcaaattctttcatccttttaacagtatcgtttgtacagcaaaacttttaatcttgatgaagcccaattatcaatttttccttttataaattatacttttgatatcaagtctaagaacactttgctttgctctattgcctaaaggatgttttctaagtttttattctaaaagttttataattttacattttagtccatgatccagtttgagttaatgttttactaacttttgagacttctgttgaaattcattttattatatatggatgttcaattgctccagcaaaatttattaaaaaggctatctttcctacattgaattgcttttgcacttttgtcaaaaagcagttggaaatttgcatggaactgtctgagttctctgttctgttttattgaactatatgtctatccttcagccaaaacagcactgtcttgattatcgtgactagaaaattagacgaagttagtagaatgctatcttccactttattattttacaaaattgtttcagctgtgttagttccattgcctttccatatacatgttagaatattattgtctaaaatttgataggaattttatcaaacctgtatctcaaattttttgtaagaattaggttaaatgtatgccaatgtagacagaattggcataattaccatgctgaatattccactctatgaaaaaagtgtgtttcttcatttatttaggtttttattaatttatttcataaagttctatagttttaatataaaaacactgcatatgttttactagatatttcattcaattttgagaaattgtaaatggtattgtgttcaaatattcattactaatatacataaatataatggagagagagatgggagagagaaatttgtgtgaagaaattgcctcatatgaccatgaaagctagtaagtacagaatctgcagggtaagttggcaggctgaccaaggaaaaccgtattttgcacctagagtgtcaagacaggctgtaggcagatttctctctccctcaggggagccagccttttctttttaaggcttcaagtggttggataaagcctatctaaattaaggaagttaacctcctttactcaaactctgctgatttaaacggttatctcatctcaaaaataacttcaaagcaatatccagactagcatttgaccaaatagctggataccatgtcctaacctttatgtatacctagtttatttaaatataaaattaaacatcaaaagtccaaaccttgtaaacttgtcacacatttctttaatccatactaaatcttcaagcaaagacaataacaaagtcatatttcttgttttcatgatacaagtacccagcatacaaccacaaatgcactaactcttgccgaggaaaaggatgcaaagaccttgagtgatcttcacttatctccttaatatcctgtaactaaaatactacaacacaaagttaacattacttaaatgctatgatatgaagtcaatacatgttatgttctataataaggttataagataagaaaacaaagatatttgagatatatatatatatatatacacacacacacggaaatgtttttgtaacaaaataagaaatattcatgacagttatagtcctatcatttctgtaagtgattatgggtcatagctagtatttatgactaccttcttctaatccattctgcattctctttgcccgcagcaaagtgggcattctttacttggtggaataagctaaaatttcattactgaagggtttgggctgttagtagtcttgcttgaatcagattgttgtagtttactgttgacattaatcatagggaatggtgatactaagagatgccctaagttatctcctgtattttaggcatgctcttccttatttccattgtggactaacagtccaatttccccttggtaatcggataaaacaccacaaccacacagtaactctcttatttgcctgttgactcagaggaatgagggttttgaactggccaggcagcagtcttgatttccagctcaatttccttactagttatagggctattcaaattatctatttcatattgagtgaattttggtagttggtgttttttttggtagaaataggtgtatttcatctaagttgtctattttatgtgtatagagttgtttgtaatattatcttattatccttttgatatctatagagtctttagtgatattctttatttcattcatgatattgataaattgtgcctgtctctgtttttgtcagactgtctaaaggcttattttattgatttttcaaagaacagacatggttgcctctatagattttcctttgttctcaattttatttattctgatcatatattatttccttcattctgttgcatagcattaattttgcacttcattttttttagttattagaaaggagcttgcattattaatttgagaggttttcctctcttcaaatgtatgtatttagtgctttacatttccctctaataaccattttatctgtgtctcacaaattttgatgtgtttggagtagctagtaactgtgcagcaagagaggctcctcatttgcactctgctggtctgggtgggtgtgaccagagtttttttcttggtgtttgactgcagaactgcaagtagggcctaaaggttttctgtcatgctcagctgcacttttcctggtatttggatggaaataataggtttttgggaggttttcctttttgcttttgtctgaacctatttggtgctttcaggttatcaccttctccagaacacaatttaggatacgtgagaaaaaaataaaacctaagtatatcactgcactgttaattatttgagttccatggttcctagccagtctgccttcctgccatcttttctccacctttcaggtttttatgttttacgtatataaatgtaacttatattaacataacatgtttttaagttgtacttagtgggtgaaataaggaaaagtgcatctacttcatcttccttataatctacttttgactcactccaaactgcttttataagtccttcagaaaagaaaaaaaagcattgttttcaaatccacatacattaaaatggtgtacaagttctgaactaattgagaaaggaatgtagttcttatctgcactgagctactcagtttgaactaattccagtcatttaatgtatactggcttaagttctcacttaggaaagagggctaactataggttagcatctacaggccagagtaccaacctgcttggcaatatccaatgattatctgtatatggatgttgtaaagttctcttatatcatacttgataattaaagaaaactaatatcaattctaatattcaatgtaatatacatactgattgaactatttccctcaagtagatagtattttcataatatttcaaatacagattgttttgaagaatcataaaaccatagggcttaagctcatagtattccagaagaagtaacgctatctgtgaaaaaagaagccactgcttccatattccatccagaacaaaaaggtaactattacctcggcttatcttgcaagtgaacattctgatctatctatccctttgctcattcagtgaatgcaacttcatagaaatcattgtattaggtgctgctggtaacagaacaaggagtcaaaactttgggctagatgactagctcatgacccaccagttgaattggatctgcctggtttcataatttaatttcaattgaaagcttttggctcaagccaagcatatgaatttgaaagggatatcacacagaagcagagatgaaatgtttcaatatcacaacaaccaatatatcctgggcagacagggacatctgatggctcagaggcagagaggcagagtggcattgtcctcataccaaagtgaaagcctgtagccagctgaggcccccaggcactgttgtccctcatggcacagagctgcctttgccattaaagaagaaagagaaacaaagaatgggaagttgaaggatgacatgtgatttatttctttcctcaagacttaacataatgtctgggacattacaggacaaataggcactgcaaaactattcaatgggaataaactactctgatttacaattctttcccttgctgtccaacactggataaggcagtgcttcactgagaatgtcaattttcccatttgtaaaataggaatgaaaataatattatgttgtttcaaggacagaatttgtcaatgtccataaatgtactttgtgaattttaaagtgctatgaaaatttaaaggaaataaaatttatctaccatgcctaccttcctccttgtagacatgaacatgcccaatgacaaaacattattactattctatttaatgaataatttaaattgcaataatccccacacaaagcataataaagtaatatttattttttacatttaaaaacaactttagcctgaaactgattttttaattaacattgaatttaccaataaaatggcaatcatgtataattttaaatgtaaatggtagacccacccaagctatcattaacattgtgaaaatatggataatctatcaatttccaaaatcaatcaagagtttaccgtaaggtaaaacatgaaatctaataaaaagaatcaaccatgagccatcagtattttattactattgaacttgcccacctgaaagttgagataaagctcgttaactcagcaagattttaattctaatttcctagaatgaaaacataagttttataccaactgaaatgttttacacttgggctttgcgatgaaatgtttttccccttacacagttcctatcaatctttcacctcctgcatttaccctgaatctaaaactaatgaggggatctttttggtaaggacacaaatcatgaatcataaatctccctcttggagagtatagtgttaaaaaaatatattctgaaaattgagacaacggcagtaaaaactgtgataatagagcattctcaggactgcagagttctgagtattctataaatttcaagtgtcaagaacctggaaggagtgtaaaagaagttaccatttaatttaatagaggcatagtagatttaatagaaactcgagattctcagaattagaactctaataagagatgcttattgattgccacaggggcagagtaaagtgaaatcttacattattcatgttgaaaatcttgaaatagaatgttcagacagatttcggtatgaacatgtttgcattcatattcccattcaaagatgagtatacagaagaaaagaaatggcaaagttccaatggcaaaaaataacatggcacaatgaaggaaaaatacatcttcttgaagacgtgggaaaagtgtagatctttgaatacctgatagagaaactaaaatattaaggcaaaaaagttgtgttcaatatttttagaaatatatacatatatgtatatatacattaagcttcctaaaggaataattgtaataatgctatcattatgtcttctcaataaaatacatcttaaaatatttttctgctatgtaatatgtattttatatataacttttatattcttattggaaatatcagatattttaaaaattatataaggtatattttacatttctaatctcttgctttcttttaaaaatttgtattttcggactggcgtggtagctcacgtctgtaatcccagcactttgggaggccgaggcaggcggatcacgaggtcaggaaatccagaccatcctggctaacacgtgaaaccctgtctccactaaaaatacaaaaaaaattagccgggcatggtggcaggcgcctgtaatcccagctactcgggaggctgaggcaggagaatggcgtgaacccgggaggctgagcttgcagtgagccaagatcgcaccactgcactccagcctgggcaacagagcagagcgagactccatctcaaaaaaaaaaaaaattatattttctttcccaaaagttaatcttaaattaatcttacaaaattatacattttatcttttcttttctgctttctaacttactttcttcttctctctctctctgcctctctatttttttctttttccttattgttatatcacaaagagatttgccacacctcctacccatcttctgttagtcttcttgatccaacttgccccccaaacaaaataattaaaatatttttaaaaatttattcttcctcagacaccataaaaacatacttcctaataataattttagatgcctatcctactaattatttttgattttataaatattgaaattataattacagaaaaaataacattatgcaattattactaacgagagagaaaaatgtttataatttgctctttttgaataaaaataattttctttaaacaaattagaaatttttattcaataatcacatccctctgagttagagattaatgagagtcatactaacatgcattcctattagtgcattatcattaaaaattactttaaaaagtttattttaatgcatcacaataaatattatagaaaacatttttctattatcaagtgagtttcactaaataaaatggatagttggggagattataatgagacctaattaatctgattaaatgtgaaaaggagtaagctatttaattctctccatgggcccttggttttgagatgtgtgtctctataacaagcggtgaattattgagctcaccactaccagacagggcacacaagtggagaaagcaaactagagaatggaagttggctgtgctggagtaagcattaaattctgatctctttagatgatagccagaaacactttccactcgtataccttctggattggagactggcaaaggaataatgcatcagctggacaggaaagatggtccacgaagagcatggtgtctgttgttaatctcattattttgagtaggaaagtgccttacctataagcacattctatctgaaatcattttctaatacagagatcagagcattgaactctgaaagcaaagaaaataatcgtttaaaatataaaacaaacataaaactagaacttcaaatatacttatatcttaggtgcctcattgtccctgtcctcccagcatagacttaaaatcacctgttcctacttaccttagtgaaaagaggaaagaactattccagaagaccaagctataattataagtagttttccttaaacagcaatccttcatttaagagaattttagcaaaagaaaaccacattgctaaagacttttgtggatatttacatagaattataacacagtttcaaaggtaagctattttgaacttgtggccatgttcaatttggaggtcagtttgcaaggaaagcaatatatttactcctttttaatctcagcaacttgaatgtgagtcacaaagcaatacagatgggaccataaacaatagtctcatgacaaaaactgcttagttttaagaaagaaactaaaagagccaatatattttcatgttacaggaatactacaactcagacatatttcacctttccaactaaaatccagtcattgtaatttaagcgttctcttacaatggctgctcttttagctatttatttgcaaatttcaatttttaatatattcaagttgtataatattctctatgtatgacaataaaaacagttaaaaggctgggtgctgtagcttacacctgtaatccctgcatttttgggcagctgagacaggagaatcgctggaagccaggagttcaataccagcctgggcaacaaagcaagaccccacctttatgaagaattttaaaaattagtcaggggtggtggcatgtgcttgtattctcacctattcaagaggttgaggtgggaggatcacttgaacccagtaggtcgaggctgcagcgagctatgatcatgccactgcactactctcattctggacaacagaacgagaccttatcttttaaaaaaaaaaaaaagttaaaagatactttctttgacattgtgcttttgctgaacctaatgatatttttcaggagccagagaaaatactgaactaggataagaatataacataaatcaatgggtgatcacaataggaaaaaaatagtttctgattaaactttaagtgggaaatctattgattaaaaacagattactacatttgtttcccaacaaattctgtgtgcaccttcattatcttaactgtaaagtgttctttaaaaagagttacattccaccatgtcccacttcaggttaaaatcaatcctttaatgtcttcccttacttgagatgaatcccaatccatcaccttggctagaagggtcatgactgctcttcatgttgcttgacttatttagcctattttgatgctctttctctatgcctattctacttccatttttttccctttcctatctcaagtttttgctcacctttcctcccatccttgaaatgcatttttttcacttttatattttcctccatggctacatttattttcctttttggagcttacactaaatatcttctaggagaacttaaacccatatcaagcatgttcttctcatcgtttaattcaaaacacttatttgtttttttatcacattaaaaatctataattatttcctttatttatttcttataagtcagccttctcctctagcatgtgaaaactccaaaagcaggaaatatttctattttattatgcccccagcatgtgtctgacacataatgggttcttaataaatttttcgtaattattctattcttttataaatattgttgaatcagcaaacattataaaacatagtggaagtaaatgaatttgatcactttgagaaaataaaactgttattacctttttttcatttctaaaagaacttgttaattctaacctatttgttttcccaatccaggctaactttttatttaagaattttgaatctgaactggtaaaattatgctaaagaaaataatgtgccatataaacacatacagcatgtgttaaaaagttgaaaattaaccagtgaatttgatatggatagactattagcttacataattctatttaaaaatgatagactggataaagaaaatgtggcacatatacaccatggaattctatgcagctgtaaaaaagaatgagttcatcatatccttttcagggacatagataaagctggaagccatcatccacagcaaactaacacaggtacaggaaaccaaatactgcatgttctcaatcctaagtgggagttgaacaatgagaacacatggacacagggaagggaatatcatacactgaggactgtcaggtggtgaggggctaggggagggatagcattaggagaaatacctaatgtagatgacaggttgatggatgcagaaaatcaccatggcatgtgtatacctatgtaacaaaactgcacatgtatcacaaaacttaaagtataataattttaaaaaaatgatagtggtttgtgatctgtgcaattcaaatgaaatataacattgcaaaagtattattttatggtgtgttataaaagatgacttccagagaaggtggctttaggagatcattaacacactgttgaataagaatcagttctatcagatttcacaatatgttcctcagtaacataaaatttggtaatgcatgctaaagtctactttgcttttaaaattttcagatgggacagcttatttacgcttttatctcataaggatcagagagtgtcagtgagctattcagtctctatccatcagcttgttaatatgagattcccctaaagcaggaagttattcagtcctgcattcaagagtgcctccatagcggtgactgtggaaccttgatcatcttgaatacagtgattacatcttagttatttttctatcttcccgctgtatcacagtgcctggcatatattagtgccccatgaaggtttaccgaaggtatttaaccaaatgcattagccatagtttatctagcattcttgaaaagttataaaaaggattacaatggcaccttagtagaatattcatgaaatagaccttttggaaaaatgaggagattgagtagatttttgaagatcaggtagtaggtaggcagcctgatcaattctaggttcacagaggaaggctccacagaagtgtgttctcttctttgcggctaaaggatgctgaagagcacaaatcaaaatgtagacttcagtcctaattacaggtaactcactgtacactcacaaaatcagacaagtagactccatgtgtgctaatactcttccaacagccaaaaaaggttgtttcttaaaattttgatcttagatgcagaactcaattttcaatatttatgtattcagtatgttaggtgccatttgatgataaagcgatgaatcatccaactctagaacaattggaaacagcttctgatttttacatgctgtgaatcaagggagtagcactctattaaaagaggttgtaatgtggagattgtgaatttcatctgctgtgagtcactgtgatggtaaacttttgtattaattgtgttttcatgttgctcgagggcaaactgctgaaaggagattattgtaaataagccattagtataaaaacccattcgtgtcatatcaagaaaaaagccgaagaaagctattaactttactctgtcagttagctatgtaactcatgcatcctagaggttttctgttgtaaggtaaaaaatgctatatgaatgcaatggtaaagggtatcagttattaaaaaaacaaaaatattttatttaaaaagggtgaaaatattttgcattgcctaagagattctaaaagcttaagaaatgtgagcagctggaggtccatctgttagtatgaacataatgagacaatttctcatggagtagacagcaacccacattatgccatgcactgtataataagtgtagcttgctgtgtgtcttacttaaaaaaaggcaaaatgtgagtttcccatgatgctctcattgaatatataaaaggaatatgagcatggattctttatcatagatgttgactgctctaagtaatagagttttttttttttttagacgtagtttcactcttgttgcccaggctggagcgcaatggcacaatctaggctcaccgcaacctccgccttctgggttcaagcgattctcctgcctcagcctcccgagtagctgagattacaggcatgcaccaccatgcccagctaattttgcatttttagtagagacagggattctccatgttggtcaggctggtcttgaactcccaacctcaagtgatccacccgcctcggcctcccaaagtgctgagattacaggcgtaagccactgcgccctgccaggaatagagatatttaaaggtccatattatggtatgctgatgctgtatttagcacagaactatagtccaacatctaagaaatagaattcttaaattcattatcactatttgtgaactaaaaataatagtgaaatactagaaataagaaaatgtacttaggagttcctgtccccatagaacttctattttagaaagaagccatagtgctctaaatattgctcctctgctctcctacacataagacactactcatacatatatattccaaatgtctcttttgaggagaagatattgaaaaaaaacaaaactgtttagaaccttaaaatattaaatatcactaattataaatattataaaacaaatcctcttcagtacagtggttcccttcttttctgcagctctgatttgaagggcttgagaaatggggaattaacaaaaaatacaattcttatacattttttagaattccaaaatttcagttaaattccttctatttaaaagtgcaactgtggagaactaacctcgtaacagaaaattttgtgtaaaggttaccctttgggatggcgttacggatgttgaaagaaatggtaaaaatgtaagcttctgaagtttgtaatgttttaaagttgacccattgcttgctagtgcataggacaattaatctttgaattattaggcaaataaaaatttctatagtggtattttacttagttgtaaatagttccgtcttcacatatttctttaggttttatgctatgagttgattaattatattgcacattctattataaaatgctatatgccagacttctatttacctgggaaagtggaatagaataatgtgcagtggcttattaaactgaagggacctgaaaaacattgctggaccaattatgttgaaaaacatgttacatatattgtgagtaaaacaaaatgtgtatacctataaaaatatgctatttgtgttctacttagacataagtggcttttgatgagggaggtagacagtgtaggggatcaggaagagagaaaagcagaataacttgtgggaactttttcacaatacaggaacataatcttccttttagggtaaagcaaatttaggcttattaagtttaaattattgaatgcatgatgcacacccagttactagcagatatagatttgaacccagatatattctgtcttgaaattccatcttcttatctactttgttctatgtagacatcatttataatatataataaattataattatatatacattatatatgtttgtgtgtatatatatatatatatatatgtaatgataatatctcagtgttcgtcattaccctggggaaccactctttctggactgttatatattatagctacctttctctttatacattttctctaatgttgacctaactcagaacatattggtgggaaaaaggacatttaactgctgaagaaaaacaaaaataataattgtcaagaaaagacagctgagatagaggcagagtcctcctgaaaccctggctctcatcataatgggaaacaattccatgtcattcattcttgggttaacagagtttgtagctatttcttactatccgacactgcctgggtttgtcgccacaatattcgtcattatatatattacagagctctctaaacaaaaaaaaaaattccaactgcctgtaactttttttccctttcactacagtatagtcactaccaagagacaaaagaatcagttatatttcttaaaatccaaaacaaaggcatcaaatgtagtagaattgtcttcttattcttatcttaagtagctcagttacgtttttccacatctaagtttattgagtttctataatgtggcttttgaaaatgatttacagagaacacagaagaaaagctgtatgttaaaatatacacttcttgatattttgttcagtgatgacattcagagtgagatgactgtaatgttggatattgtttcacaatgaattaaaataattgaatacattattattaagaatcacagaaacatactataaatacctggtgattcataatgatacgtgtttgtaatatttatacatctgtgtactttgttcatttataaacacagaagatatagttggtgttctacttaaagatcagaaagaaatctatatagttttagacttattcttctagttaatatatatgtgaacatacttatttgtcatatacttactgtactttctttctataatagtagataataatatttgacaatacataattatatttgaatttcaaaagatcactcagccacagttaagaattggtatttttcttagactatattataaaaactattcttttttaagtcttgcaaagtttttgtaaaataattacaaatgcaaatgtataaaatgcaacaacacggaaaagggtgaaatgtattaagtatgattttaaaatatactagagtttaattcaagtgctgtagatgacaaaaccttattgaaaaatatttccaaagatataaattataggcaaagttacacagtttattaatagtctatattgtgctaaatctctagtctctcagtctctcaaatcagtcctcccaatcacctagccacaactgtgttaaattatttctgtgtcttggtcatactttttattccaccctcatcaccatccccacatttacatatctactcatcaaccttgcttttttataatattgatttatgcaggggaaaaatgtccatatttattcattcagtacttctcaggagtaatgaagtctgcaaactttctatagaaatacaaatattttggctgggcttggtggctcctgcctgcaatcccagcgctttgggaggctgaggcaggcagatcacgaggtcagaagttcaagaccatactgaccaacatggtgaaactccgtctctactaaaaatacaaaaatttgccaggcgtggtggtgcatgcctataatcccagctacttgggaggctgaagcaggagaatcacttgaacctgggaggcagaggttgcagtgagcctagactgcaccattgcattccagccttggcaatagagcaaggctccttctaaaaacaaaacaaaacaaaataaaaaatacaaaatgtttctaatcaaaaggactcacacaaaagttggatctaaaaatgtttttttgtaaatgagtatatgtcccaaaaatttttccattttctgtatatttgaaattatttaagaagttgagtacctacaccaatacatatgctactgtaaataaataatattgtcactggtcattaatgccattacagcattttttctcaaactcagtgattacctgtcagggaaacttacagcttgacaagacatgaaccacaaagagattcacaacctagattaataaattattttaaatgtagaattacatagacatgattttcagaacattgcaaatgatataaatcttaacattcataaataaaacttctagaattgccagatgtttatatcagttcttaatattttgtgaaaaagtatattgaattttaatatcagttgcaggatattaataatatttataaaattatcatttcctattaattcttttaaagaatctatcattacaaagtttctacaacttttcctgagcccatttgtagcttcagcttgtatttgttttggaatacattaatgaagacagattttataaagaaaggaagcatgttttggagtcagatacagaggctgttaattcatttttctaaattttgtcactcttttcgaacagataacttctaagtatcagtttccttttctgtaatacaggcacattaatatgttattcataatgttattttgaaattgaaaatgagaaaataaaagtgttaaatttcttaacacagtgcctacaacataaattcaataaatagtggctaatattgttctgattattatttgcataattatagctctcatactgagctttcccccagcactagactcaaatttgaaatctgactagattctaaatctcaacgtttctaaacagaatttagcatctttacccatataaatcagttttgcttaaagctggcttagcttttctcatgacgcttatatcaactggcactactattcattgtcatcataataaaatactagctctactgcacactggttgggaaccaggggcagataggggaggagggcataagagaagaaactgagccttaatttcaacatctttaaagtagaaacatttttaagattggtctcaacacattgttgtgattaaatgttagtatacacaaagaacttaactttaccagccacaaagcaatgattcaataaatgctaacaattgttactttattattaaattaaaattttcttttaatcacaaatgtatttcttacatcaaaaaaattaagaactctaatagggccttataggcagttttcccctatatgtacactattctttcccatgtgttttaatatcttacccttttaatgattttaacaactccaggatatgcaagagaggcttaatagtgttttttttttctctattctccttaagatttcttatcaatagggttatagtctataatgaacttattaagagtttttaataatttcagcttgaagctcttcaaaatttataaatggagtgctttaacatgaaaagctgaacattcaatttggacagaactctctcatactatagtcacccagaaaaggttgttaaaatacagcaataagaaatattttagtgcaaaacccagcttaaaacagaaaaaaaaaaacagaatagaaaatcctcaggtgatacaagcgaaaaaggtaatcaaagtcagatggggaaaagtaaagacagttttacacatggctgaacgcccaaggggttggtcgcctgcacgcatggaactggaaaggcaccttctagatcacggaaagcaaggttacatgaattatgtttgggtctgctaaaaactattccttcagttaaaataaaagaaagaaggtggagatctgactcacttgttgagagcaatagtgggaaaaattgtcgtctacataaagtcttagtgaaagatcagaagcactgacctgtagttacaggagttccaagtttagagcgtaaaacaacaatcagacaagaacgactgaattcctttggtactgatggagcaaaataaaaaccactccgctggaacatttttataccatagtcattggtgtaccatatgaaaaatttaaccctcggaaaaaagaaaagtttatgaaaaaaacacacgagagagagagagggagagagagtacatgagtatgtgttgggggcaggggtgtggatatcaatgagctcaaactacaggacaaataatatctgaataactggaaataatacattactttgaaggagacaataaattaagtatgttgacataagaaataaaagcagacatagattcataatgaaaatatagttcattttgaaaactgaaaactcagatttaaaacaaaaagaatgctcaaaatttggaaagagtgataaaaatcgaaagttcaatggataaatcagactagattagggaattctgaagaggaaaaaacgtggtctgggagacagaaatgaagaagtacccagaattcagtgcagagaaaatataaaaaatatgaaaagaggcatggcaaagaaaaggtaaagttagaagatgtaaattatgcttaattgaaaatcaaaatgtaaaaaataatatgatgagagaaaatatttgaaagtataatatcccaaaattgctcaagtacatttatttccaaactaaaggcactaagtgcaggtcaagataaataaaaacaaatctgtaattagacacatgttggtgaaactagaacaacaagaaaactcaaagaaacttgcctttttcaaactggaattttctcaaagggaagaaaaagcattttttttctggcaaatcataaccatactttgcacataacataggttttggagtgccttctcacctttagtgtggtgtaaaaatttttaaggtgagaatcttatttgtagtagtttggagttattatgtccatatgaaccttgcaaaaacaagaaaacaaacaaaacacacacacacacacacacacaaacacacacgattcccctatggagtagtacaatttcaatcctgccatcaaataattcccataagcacagttctaagaaaaaggagcagttcaaagtaaacagtctcaaaagacacaaggaccaaaggctctgtgagtgaatcacagaagaaaataacacatatacaaaccagacttcaagagaatttgggtactggaattataaaacatgacttaaaatgcaatatttcatatttaaatgcaagtatataaatgtgtgtgtgtcaattgttaacataaatggaacaaggagaaaacaaaggagtttcattgcaaaattaaacaaatataaaacatatagaaattttaaaaatagatagggctaactagagggtggcaagatggctgactagacatagccaggatgaacatttaccaccaagggactgggtcaccgggaagactgacgcactccaagcagatcttcagagggaagactttgtgggggatggagggaggacacagacactgggctgaagcatggtacctggaaatcctgcatagggttatcgcaaaccaggacttgttcctggctcccaacaactccttgaaaaggggtgagttgagcaggaaaagaacaactcgctctggctatggacctctggaatcctgtcagcaagataccctacaactcccatggacatctgagttggcagggacagctgcttagacaggtgatagtggcagaactccagatggtgcagagtccagagggtttggtgtgggagcatctgcagtggagcatagccagtgacacccatctcccagggcttgccttgctcccacagtagactttagccttaggggtactgttggatctgaacagagcagggtgatcttgcccatgagacagggtgagtccaacctgagtatccctgtctgctggcctctcccagggccccagcctggccacacctgcatttagtgcagcctccccaaactggagcctcctctgtgccctcctcagactggagcctcctctgtgctgctttgccagcatgcacttgcccacggccacacaccacatcactttgtcaatgcatgtgtgcataggcagaccttgctgcttgttctctacaggtgctgtgtgtgcttggactccactgtgccactgttgctggtatgagtgcaaactaccccaccaccacttggccattgctggcacacacacacacacgtggatgtcagcagctctgctgcctccctcagcaccccctccaaccccactccaaacctccccaccccagtccacaccatgcccccaccaccaccactgcaaacacctgcatagaggccagtactgctatgcctgccagcgccccagtacagtcagcaagcatgcaccctgccatgttgcccactgctggcctgtgtaaaagagcaaagttcctgctgtcactgcctgataaagtgctttggctgacatcacccattggaatactgtgatcagcagtcctggaaaaccttggcccttccagtgcagcaagcttctaatgtgaagtcagggagaaaaagccaggggcctgatgccaccccccccagaattagagtatgcagagccttggctccctaaagtcctccagaaatgatgccagttgactgaacccctgttataacatgatcaaacccccaaggatatcaaagataaaagaaaaataaaaagctcactcaaaggaaagcaatgccaaagactgaaggaatatcagcacacgaagataagaaagaaccagtgttataactctagtaactcaaaaagccagagtatcttcttacttccaaatgaccacactagttccataccaatggttcctatccaggctgaaatggctgaaatgacagaaacagaaagcagaatatggatattcaataagaacacatattattgaaaatcaggagaaagtcaagcccaattcaaagattctatgccttacactttcactacataggagatgaaagatgaaatggccattgaaaagaaagaaggaaggaaggaaggaaagagagagaaagagaaaggaaaagaaaagaaaaggaaaagaaaaagaaactactctgatagagttgaaaaactcacttcaagaatttcagaatacaaacacaagtattaactacataatgaaccaagatgaggaaagtatctcagagctagaagactggctcacttaaatgacacagacaaacatttttaaaaaataaaggagaatgaataaaatgtccaagaaatatgagattatataaagagaccaagtctatgactcattatcatccctgaaaagagaatgagagaaagcaagcaacttgaaaaacaactgagaatattgtatattgaagactggagaatttacccaacctcactagagaggccaacattcaaattcagtaaatgcaaataacccctgcaaaatactacacaaaaagaccatcctgaagacacacagtcatcagatttaccaaggtcaaaatgaaagaaaaaaatgttaaaggcagctagagagaaaggactggtcacctacaaagggaaccccatcaggctaacagcagacctttcagtggaaaccctataagcaagaagagatttggggcctatgtttagcattcttaaagaaaataaattccaaccaagaatttcatatccagccaaattaagcttcataagtgaagaagaaagaagattattttcagacaagtaaatgctaaagaaattcattacaaccagacctaccttacacaaggatttgaaggaagttctaaacatggaaaggaaaactagttactagccactacaaaaacatacttcagaatatagaccagtgacactttaaagcaaccacacaaacaagtctgcataataaccagctaacaacacagtgatgggatcaaaactgcaaatatcaatactaattggtatggtttgtctgagtccccacccaagtctcacctcgaattgtaataatcctcatgtgtcaagggcaaggccaggtatagataattgaatcatgggaggggtatcccccacactgttcttggggtagtgaataagtatcatgaggtctgatggttttataaatgcgaactcccctacccatgatctcttgcctgctaccatgtaagaggtgcctttgcttttcttttgccttacaccattattgtgaggcctccccagccatgtggaactgtaagtccattaaacctctttcctttataaattacccagtcttgggtatgtctttattagcagaatgggaatagactaaaacagtaagttggtactgggtagtggggcactgctgtaaagatatccaaaaatgtggaagcacatttggaactgggtaacaggcagaggctggaacagtttggagggctcagaagaagatagaaaaatgtgggaatgtttagaacttcctggagacttgctgaatggctttgcccaaaatgctgatagtgatatagataataaagtccaggctgaggtggccttagatggagatgaggaacttgttgaactggagtaaagaacactattgccatgcaaagggaatggtcacatgttgcccctaccctagagatctgtggaactttgaacgtgtgagagataatttagggtatctggcagaaggtcaaagggttcaagaggaagcagagcataaagaattggaaaatttgcagcctgatgatgcaacagaaaaaaaaaatggggggggagaaattcaagcaagttgcagaaatttgcataagtaacaagcattcaaatgttaatcaccaaggtaatagggaaaatgtctctggggcatgtcagagaccttcaaggcagcccctgccatcaggcttagaagggaaaaatggttttatggactgggcccagggactcctgctctatgcagactccagacaagtcgccctgtgtcccagctgcttcagctcaagccattgctaaaaggggccaacttgaagctcaggcttgagttcaagctcaagtttcaaagggtgcagtttccaagtcttggcagcttacatgtggcattgggcatgcaggtgcagagaaatcaaaaattgagatttgggaacttccatctagatttcagaggacgtacggaaatgcttgtatgtccaggctgaagtttgctgcagggacaggaccctaacagaaaaccactgctagggcagtgcagaagggaattgtgggtccccacacagagtccccactggggcactgcctagtggagctgtgagaagagggccattgtcctccaaaccccagaatggtagatccactgacagcttctactgtgtgcttggaaaagccagagacactcaacaacagcctatgaaagcggcctggaggagggctataccctgtaaagccacagaggcagagctgcccaagatcatgggaacccaactcttgcatcagtgtgacctggatgtgagacatggagtcaaaggagatcattctggagctttaagatttgactgccccactggattatggagttgtatgggcctgtagttcctttgtttaggccaatttctccaatttgaaatgggtgtatttacccaaatgcccattacattgtatctaggaagtaactaacttgcttttgattttacaggctcataggcagaagggacttttctcagatgaggctttggactgtggagttttgagttaatgctgaaatcagttaagactttgcaggactgttggagaggcatgattggtcttgaaatgtgaggacatgagatttaggaggtgttggggtagaatgataggtttggctgtgtccttaccctaatctcaccttgaattgtaataatgcccatgcatcaaggatggggccaggtggggataattgaatcatgggggatgtttcccccatgccattttcctggtaatgaataagtctcacaagatctgaagctttttcaaatgggagttccactgcacaagttctcttctgtgttgtaagacatgcctttgcttctcctttcgtggactgggcccaggcatcctcagccatgattttgaggaatcctcagccatgtggaactgttagtccattaaatttatttcctttacaagttacccagtcccaggtttatctttactggcagtgtgagaacagactaatacactaacctagtatataaatgagctaaatgtcccaattaaaagtcacagagtggcaagttgaataaagaagcaagacccaactgtatgctgcctttaagagaaccatctaacaagcaatgacacgcatagactcaaagtaaagggatggagaaaaatctaccaagcaaaaggtaaacagaataaaagcaagagttgttattcaaatttcattcaaaaccgactttaaatcaacaaaaattttaaaacaacaaaaagagtattacataacggtaaaggcaagaactaagtatcctaaataggcatgcacccaacacaggtgcacccagatttataaagcaagtacttagagacctatgaagagacttagataaccaaacaatcatagtgggagacttcaacacaccactgagagtattagactgatcattgaggtagaaaactacaatttttttttagtttaattcagggcctgaactcaacaactgaccaaatagaccaaatagacatctacagaaatctaaagagagaaagtcaaactatcccagttttcagatgatacaattctataaatagaaaatcccacagtctctacccaaaagcttcttgagctaataaataaatacaggaaagtttcaggacacaaaattaatgtgcaaaaattagcagcatttctatacaccaagaatatccaacctgagagtcaaatcaagaacgcaatcccattcacaattgccacaagaagaatgaaatacataggaatacagctaatcagagaggtaagaaatctctacaacaagaattacaaaacattactcaaaaaaataggaaatgacacaaagaaacagaaaaacattccctattcatggacaggaagaagcaatattgttaaaatggtcatactgcccaaagcaatttatagattcaatgccattcctatcaaactaacaatgacactctttaaataatgagaaaaaatgatcttaaaattcatatggaaccaaaaaaagctcaaatagcttgggcaaccctaagcaaaaataacaaagcctgagacatgatgttacaggatttcaaagtacactacaaggctacagtgaccaaatagcatggtatggtacagaaacagacacatagaccagtggaacagaataaagatcccagaaataatgctgaacccccatgatcatcagatctttgacaaagtcaacaaaaacaaaagatggggaaaggattccctattcattagatagcgctaggataactggctaactatacgcagaagatcaaaactggaccccttacttacaccgtatacaaaaatcaactcaaaatggattgaagacttaaatataaacctaaaactataaacatcctggatgataccttagaaaactggacataagaactggcaaagatttcatgccaaagacaccaaaagcaattgcaacaaaagcaaaaattgacaaatgggacctaattaaactaaagtgcttcagtgcagcaaaacaaaacaaacaaacaacaacaccaacaacacaatctatcaacagactaaacagacaacctacagaatgggagaatatatttgcaaactatgttgtctgataaagatctaaattcagaatccataaagaacttaagtcgacaagcataaaagaaacaaccccattaaaaagtggccaaaggcatgaagagacacttttcaaaagaagacatacgtgcagcctacaagtatatgaaaaaaaatgctcagcgtcactaatcattagagaaatccaaatcaaagccaaaaagtgatatcatctcacatgagtcagtatagttattattagaacatcaaaaaataacagatgctggtgaggttgcagagaaaagagaacaccttgctggtgggaatgtaaattcattcagcctttacagaaatcagtttgacaatttctgaaaggactcaaagcaaagttaccatttaacccagaaatcccattattgtgtgtatacccaaagggatattaattattctgtcaaaaagacacaggcacacatatgttcactgcagccttatttacaatagcaaagacatgtaatcaacccaaatgcccatcaacagtagactaataaagaaaatgtagtacatgcatagcatggaatgctgcacagacataaaaatcaatgagatcagttcttttaaggatcatggatggagctggaggccattatcctaaatgaactaacacaggaaaataaaaccaaatactgcagcttgcctgtataacaaacatgcacatgtatacatgaacctaaaagttaaaaaagacagaatattaaaaaaaatgaaactgcaatttaatacatagtttaaatagtaagtcatattttaaaaaattaagtagttagcaaataaacagttaacagaaagagaaatttaaattatttgcaatataacaaaaggaacaaaagatgtaaaatatgacacaaatttaaagaaaacaacaaaatctaacacatacctaacagaaatccacaaaggtatactgtaaaaaaaattgagaaggattacgaagagataatgaaaagtaaattccagatattctcaaagataaatactcagatctagacagtgccaaaaaactcaagcatggtacatttaaaaatactttctaaacaaatgatgctggaatggttaccacatgtaaaaacaaatgtatttctagacatagaccttacatagtttacagaaaaataacacagaaattcagaatggatcataaatgttgctgtggaatgactgtttatgtccacacaaaagcggtaaaatccaaaatcccaaagtaatggtaataggaggtgaggcctttgagatatgattaggatgtaggaccagaaccctcatgaatagaattagtgccccataaacgagaccccagcaatatatctggccccttctgccatgtgaggatacattacaaagtcagccatctatgaaccaggatgtgagctcttaccagacaccaattctgctggtgccttgatgatgaacttccgagtcttcaaaattgtgagaaataaatttcttctgtttataagtcatttagcctatggcatttttgttacagaagtttgaatgaaataatatagacccaatgtgaaatgcaaaataatgaaagcaaaagagaagaaaaggaaagaagaactgaaagaagggaaaatgttgaggctgttatcagaagaatcatactaaaggcaagtttaacatacaacagaaaaggattaatttcatcacacattaattcttggcaaacatgttatattcaataccaagatcatttactacatttaaaatgtactttaatgagtcaaaagtcaatgtaatcaattttcagagtaaaaaaaatcagcataatgtctgatatatttaaatactgattttcatttaataagtaattgactgaagcatttgtttccaattttaattgcataaaagttttgaatttaacatatgcatgttaatagctgacacctaaatttacctggaaactaaagccatgatatgaatactacgctaaaaatagtaaaaatgtgtttgtttttttgttttccaattattaaccctctccctctacagtccatgtatggcaagatagtaatcacccaaagacttcattcatgtttattggctgtcagtcacttagtcaggatacaaaacatatgattacttccttcactgttttattatttttgtttatgctattgttgtttggaaagatttaatacaataacatacaacttttttatatgaaatacattgcttggggaaagtgattctaataaaacgaaactttgtatgctgttagttgaacagatataaccatctttcccttatatgagaaacatatttataataattacagtgttgatgccgtacaaaattgtatatacacatacacacatacacactacactatgcatatatattttacaataggacaaaactatatatatatagaaatacagtcattcattgcttaataatgggatacattctgataaatgagtcattaggttttttgtagttgtgtgaatatcattgagcgtacctacacaaatttatgtggtgcagcctactacacatgtatatggtctagtctattgctcctaggctacaaacctgtgccacattttactatactgaatactgtaggcaattgaaacacaatggtatttgtttatctaaacctagctaaacatataatggtacagtaaaaatacggtattataatcttatgggatcgccattatatatacagtccatcattggcatcattattcagcacatggctgtatatatactcaacactccatattcattggttccatatatgaggattcaataaactctcagtcaaaattttgaggggaaaaaaaaccctgtgtctgcactgaacacatacaatttattgtcataattccctaaacaatacagtacaattatttacataatatttacattttattcggtaccgtaggtcatctagagattatttaaagcatatagggggatgtgcatagattatatgtaatattatgccactttatatgaagttcttgagcatctacaaattttggtatcaaccccacagattgtgaaagatgactgtatattttcacacaaacatatatatatatatatatatatatatatatatatataaaatatataatatggggatgtacacaaacatttggaaatatattccattttcgtgtgtgtgtgtgtgtgtgtgtgtttgtgtgtgtgtgtatggaaatatgaagtaatgggttattgaaacctaaagttaaataagacatgctccatggggggaaacattgtacagagaagagacttgtaagacaataatggtatggaatatttctaaaaatatctcgtgaggacacttggggtccccaagaccctttcatgggatctgggaattcaaattattttatataatataatgctttatttgccattttcactctcattttctcatgataaccatgaagttttaaaaggctacatgtattgtgagtacattgttactctgagagctagcaaaatatgtattcttgtgtttaaaaatattgttttaatttctaatagagtaatgtcaatagatataacccacataaacagaagctctttggagtcctcaataattttaagagagaaaaagggtcttgaaagcaaaaaaaaattcagaaccactttttagataggacatgaattctattgagaaatgcaaaaggtgtttagggaaatgaggagaaaatttactaagaaaattatagtttgttaagggagcaagatgagggactgctaaaatagactcaggttagccctgaaaattcagtcttgtttacccagtcttattatttcccaatgacatgaaacctatagagagtggggaagtctcaataaagggagagatttgtgtataattttgagatgccaaccaataatataggttctaagaatatatgattaaacaggaaacagattacttatacagagttttagctgaaatgagtccacctaaggattgggcatatttttttccatacaaagggaggtattaacaccttcccaagacctattaaggtgacaaatatgtaactgtttaattagggtaatagagactccaatgtggacacttcataatgcaactgacatgctatgaactgccattttactgagtcacattactttctttcactgtaaatgacataattgacatgttatgaactgcctttttattgagacacattatttctttcactgtaaatgacatatctcagatatcctaaaatataatttaaaactcttagtaaaatcaaattttcttaaattcatatactattatttagtgattaaacttattttaatagttaaatttaaaatatgtttagtatctagatatttgaggcttttatacatgatgtttgcattcaaggatcatgagattcagaaagttaaaatcaagcttttatttgcctaagaaacaagatatatttgcctcgcttttgacagtattataaaaggcatcactgatgaaaaccacttatacatataaagccactttaacagatgtaaagaacattgttgataagaaaccaccaatattaggtattatattttattaggtattttagattcagtggcactggcactggtgattatttcttccttttcctaaagaataaaaagatctgtcaaattgcttatcttttctacatgcatttccactgaaaaaatattcagggttgtcaagtcctaatacattattgggaaattatagctgttatttttaacataaattaagcagtcctagatattttacatgacaggtttacaattttcactgagaatgaccatgtagatactttagaaaagccatcaatgtgtgactcatcattacattattgcagtgttcatgttgaaaggaacaccagataagcttagctttttgatcctgatgacgaaggtctccatattaccaataaaaataagtgaacctggtgatttctcattatctctcttaaatagatagatttatttatgtgtgtgtgtgtgtgtgtgtgtgtgtgtgtatgtgtatgtgtatgagggaatactctgcttcattttagcttaagtattaattttgagctgttgaaaatgctttgcagactcaggaaattttgaaggatggagcatcgccactctcctatccaatattatttagtaaaattatgcctgacatgttatccattatacttaagatacttacgatttcttaagaaattctcttctcaagagggaaatgatgctaacaacaatggtaacaaggcttttctccttcatctcttcatttttctcatctatattttaaaaacttcctttgccaaaaacagtgtgttaatagtgtcaccatctgagtgtattctgtcaaaatatagcttgcacaactcacgagtgttactaatatttttgggtatttcctattgatatttttaagaatgatttgtagtactgtaggtgatgtgccatatatgagactattttctcaacaataatctttatatatactttggatcaacttttgtcttatcagaattattattaatgtatttgatgttccaatggttacaatattttttagtatagtaatagtaagtagaattgctttaaaaaaaggaatgatatgtatctgtccaagaaccaagatacctaccattgagagcctcttgaaaacctaaagaaagcagctttgagattcctgagagtttaaacaaagtggttgtaggggagagtctacaacattatggtaactgtgcacaaggatatcctttgatataaaacacagccatgaagctctcattgtagaaacaagcaaggtgggtctccagaaagaaactgcggctgtatatttacctctattctgctactcacaaatggtctgaaagagtggcctttgtgaacaaggtaacctcttaagaaacatcttggaattcttgatttgaaagtttgaaaaagcattattaacgggtaacaggatataagaaatggcaaaatacatcttcaatagtgtaaatctcactcaccacaataaaatctattaactgaatatgacagcgttccatgataatggaaaacaaatgcaagaggaaggaagtgaagatgacatgcaaaataatcactaatattcatgatataggagatgtacatcaaaactggctgccatttacagtcactacaagggaaattaacttaaaaagtttgacataaaagagtaaatagaaacaagtggtgtaacatttatttttctatgtaaatgtcaattatttgtgaagaccaatatggtttattaggatacttgtttctcttattctctggttaccaaattaaacattgagatattttagtataaaatagcaaaaggtgataaagatatatgtcttttatataaacattaaatatgatacttttgctgttcattaaataacgttttctaggtctcacattttatggcagttaatggatatttgatactatttaaggtttaaaccaaaagccagatatcaaataaaactatagtacttgatttgattgtgaactggaagaggtcccccattggcaaaggataaggcaaattgtgtgtcaataacaagagctaaaataaatagaactagatcaaatccataacttccaattgacactaaaaatatatctcatattgatgacatttggaggatactagagaaccaaattattgatcataaaactaatcaatatcagtaaagaataaagtatcttgctgacatggtttggctgtgtccccacccaaatctcatcttgaactgtagctcccacaattcctatgtgttgtgaaagggacccagtgggagataattgaatcatgggagtggtttaccccacaatgttctcataatattgaataagtgtcaaaagatctgatggttttataaggagtttccttttttagcttggctttcattctcttttgcctgccaccatgtaagacacgcctttcgccttctgccttgattgtgagacctctccagccatgtggaactgtgaatccattaaaccttttcttctttataaattaccctgagtcaggtgtgtctttatcagcagcatgaaaacaaactaatacacctgcttttcctttataagatgtgcaagagacagacttgccacacatcttttacatgacaacagaaaactatttcttgaatgcatacttttactagctaataaaacacatgaaagtcactacttttaacatataaagatagagtcaacaaatataataaaataatgtggtaatttggagtgtataaattatgctcaaacaaacttgaacccaattataactttaacatcataataagagagagaactcagaatttatgtgattaccaatgcaagtacccagcaccatagaataaatatttctataaacaaacaaatgaacaggaactctgaatcagattaatactttacagatttaggggaaatgtaggggagagagggtgagactggcaaaactcaaagtaaggggaactgtacagtacaaatcatcttttttttggttgttgttgtttgtttcaataagaatttcaagaaatagaaataaaagaggatgtattttaaatggcagggaagagacaagaaaaatatgtgaaatttttagtaaacaaaataacagaaatcagtaaacaattgggagaactgagcactggttagtttggttaatatttgatgctgtcaagaattaactgttaattttttaaatattatggtattattatttaaagaattcatatattttagatatttacagaggatgttatttgatgtattaaaataatacaattatgtaggtaagcagaaaacaagatttgtcatgatctactaattattgaagtgttgggggtatggaacaggaacgttggaatttcttataatattccatgtcagtgccggttacataatttttcttaataaaaatttcaagaaaaaaaagctaaagaaaacataaaaggaaacttgatggccatggttctttagcttttgtatggaactagtcttaaatgtaaaggaatgtaaaccttggcaatccttggagagggaaaggattattagcatccatgcaaactggaaagcttattgtccatttattttaaaataaatgctgatatttatatgttccttacatttttcatactttaaaataaataaaatgatattttatttctaataattgtcatttatatttttggcttatttatacttctagcacgccacttcaagccctaggtataggtatagtcagtgtgcacatatgtagcagttgaattaccagatatttgattttgtgaaatgcatttagtttcccgtatctcattactctgatgttcataactagggtgctccatatatatatatatatatatatgtgtgtgtgtgtgtgtgtgtgtgtgtgtgtgtgtgtgtgtgtatgtgtatatatctatatatatatatatattttttttttgagacagagtttcgctcttgttgcccaggctggagtgcaatggcgtgatctcggctcaccgcaacctctgtctcccgggttcaagcgattatcctgcctcagccccccaagtaggtgggattacaaacatgtgccaccatgcctggctaattttgtatttttagtaaagacatggcttctccatgttggtcaggctggtctcaaactcctgacctcaggtcatccgcctgcctcagcttcccaaagtgctggcattacaggcgtgagccatggtgcccggctgggtgctccatatttttatttttttctatctgtattgtatttcactgtttttatttttataaagagtaatgattcttaaactgagactctgaatgtctagttttccacaatatttaaaaagtctgatattccaatatcaaaaaatctagattgttatttggtaataactttattttggtatgaagacatttttaaaacatggctctatggagaaaataattacctccttggtgctaaaaatgtaaaggattatttatacagagtatgctgaatgctttaaaacagaactattattagattatacctcctcatatgtagtccctgtattttagtattgtcaccatttgtcttgaatattttcattaataaaaacctgttataactgactgaaataaagataatttatatttaggtagtcaaaacatttaaagagtggattgcaatctgctatggggtctcaaacatagttgtgcttcttcctaagtatccatagcccctttttgctgtttacgctgattcccaagaataaggacaaaacccagaagtgcagctttttcaatttcttcttcctttcaacttatagataagttaatcaatgacctcccattagatctgcctccaagggtatggtactattgtcttactaaatgatggagatatggagagcctgagaagggggagggcaggtgaaaaagttctggagaataagagaggaactgtgtgaaacatatgtgagagtgtcagagagggaaagagcaaaagtgactttaaagcaaaaagaaaatccttgttggttaaacgtttactgattaggagattagggaatgaaaaaataaaaaacaagaaaatcatgtgatatttaaaaatctttgaaagactttcccttcccttggtgattcacatactatcagctatcagaggtcagcatgacgtagggataattgctagtaatttgcttgtggtaattaagaaagtttaaagagatacttccagataaatcaacagcaaagcattaatgacaggttggaaagactggagagatcagagtcacacaggaaacgcacagtttgttattatagttgtccagcccacttaccaaaggaaattataaactatgattttttttaatctaaatctaaaaacacagttagaagatgggttgtgctgcaaagatgacctttctcttgagaaaaggggtaacttgtagttcctcataatagctatagttttaaatgttatatgattaagtatcatttgagaagcttgtttaaaaagcagacgccttagtctttagacccttgcaaattttatgattcaatgaccttggggtggtacccattttttgttgatctgtgtaccacaactttaaaaatacttttctagaatgaggtttctcaatctcagaactattgacattttggcccagatagttctttgttgtggggaattggtttgtgtattgtaggatgtgatgtgtttcagcacatgctatcccaaaatatggcaccttggtatttgaaaaaaaaaaaaaaaaaaaaaaaaaaaaaacagtagaagttggaagttctctctgactttctcccttgcagcagggcataaaacaattctctgggccgggcgcagtggctcctgcctgtaatcccagcactttgtgagggcgacacgggtggatcaagaggtcaagggattgagaccatcctggccaacatggtgaaaccccctctctactaaaaatacaaaaattacctgggcatggtggtgcccacctgtagtcccaactactcaggaggctgaggcaggacaatcgcttgaacccaggaggcagaggttgcagtgagccaaggtcacaccactgcactccagcctggcaacagagctagactctgtgtcaaaataaataaataaataaacaaataaaaataattatctgatcttcctctaaagtaattcataaaacctttattccagagggtctgtcctatcctaaacgtggaggaaagtaatgtccttatttctgaagacactgagacacaaagaagaatctgaataaacagggcttgctaaattccatcctctaccctttcaccccctcatccccatttattactattagatcagaccctttcgctctccaaacaaacttctctacagctgtccatgaaaaacatagctttccgtttcttcatttctgaaggctcccgtgttacttaaagcttgtacaaaataagtacaataatctgtaggcttttctcttgttaatctgctttttgttatacgggagtctcagccatgaacctagcaattggtgaggaaatacatcttttctgtgctacaaaagtttagcagcaccattggcctctacccactagatgccaatagcagccctgaccccaactccctcaattgtaacagctaaaagtctctccgttcagtgtcaaatacccacgagtgcataattgtttccagttgaggatctcagaaagtataaggagttttaaggcagagtctggtatttcagaaacacaaaataagaaatacagagcctcaagatgaaaaataaaactaaaatctcagatgataaaatgaaaaataaaataggcagaagagtgggttgggttggagaaaaaaattatggttctactggagccagatggtgaatatgaaacttttcacacagaaaattatttccacaaggacagttgtctgtaatgtcacataacagcaatactgagaggaatcatacccagggtcgagaatataaaaatgcattgctgacctcaaacttcatcagtatgcctgatgtgttatcccttgtctctgcttccaaagccccatagattaaactaaatccatttattccttcttccaatttataattgtaatgtgggaaataatgatatgaaaggaatcggatattaactgtagtaacatactagaatgtatggtccttggcaagggattagtttataaattttgtatcaggcattctgattcggcaaagtgtactttggatagggtaaaaaaattcaaaggtacttattaatagtttcatatcagtctccacatgttggtctctaataatatattagaaagctctgttgtaggacatgaccttttcaacatttatcaatgagattagtaaagatgtagaaggtgcatttatcacattttccataaatgaaaaatttaagggatagtggtgacagaataaaaatatcctaagtaggtataagaatgaaaggaaataattaacgaaatatagagacaattcacagaatgggagaaaatctttgaaaactatccatctgacaaaggcttaataaccagaatatattaggagctcaagcaattcaataggaaaaaaatagtctaattaaaaaatagcaaaagatctctagacatttatcaaaagaagagatacaaatagccaaaaactatatggaaaaaaagctcaacattaataatcattagagaaatgcaaatcagattacaatgagatatcatctcaccccagttaaaatggttttatcccaacaagaggcaataactaatgcaggagaggatgtggtgaaaggggaactctcaaacactgttggtgggaatgtaagttagtacaaccacaacagtataaacgtccctcaaaaaaactaaaagtaaaattaccatatgatccagcaatcccacttctgggtatatatctgaaaaaaaggaatcaacatggtgaagagatacctgcactcctatgcttattgtatgactattcgcaatgaccaagatatggaatcaactgaattgtctatcaacagataaatcaataaatagcaggtagtacacatacacaaaagaatattattcttaaaatccttattattaaaatcctggctggggacagtggctcacgcctgtatcccagcactcggggagaccaagacaggcggatcacttgaggtcaggagttcaagaccagcttggccaacatggtgaaatcctgtctctactaaaaatataaaaactagctgagagtggtggggtgcacttgtaatccctgccacttgggatgctgaagcaggggaatcgcttggacccaggagggagatggcaaatgttgcagtgagccgagaccatgtcactgcactccagctcaggtgacagagactgagactccatctcaaaaacaaaacaaaacaaaaaaacaaacaaacaaaatcctttgattggcaacaacgtggatggaactggaggacattatgttaagggatgtaagccaggcaccgtaaaacaaatgtggcatgttcttattcacatgtgaaagctaaaaataaagaagaagaataaaagaaagactactctggagtagaattattgttaccagaggcttggaagagtagctggtagagggggtaaagataggatggctagtgggtacaaaaacacagttagatagcatgaataagatttactatttggtagcacaataatgtgatcatagttaacaagaatctattatgtattttaaaatactgaaagagtagaattggaattttcttaacacaaaggaatggtaaatgcttgtggttctgaatatcccaattaccctaatttaattattacatactgtatgcctgtattaaaacatcacatgtgcccaataaatacatacaacaattatgtaaccataacaattaacaacaacaacaacaacaacaacaaagaatttactacaatgaggacatttggagtaacctgctgtcggaccaaggatctagtaatgaggatataggatagtgaattctggttctgtacatggaacatgtataaacaagatgtaagggttccattgaaataaaacaatgcattttaacagcatagtggaaatacaaaaatgccagtgtatttttagttgcattaatcaatgtatacataacagatacaaaaggtttttctatgctgcattggttagatcccatcaagagttttataaatagtttcaggacacataagaaaaataacattgagaaattagaacacacccaggactctataaataaaatgataaactgttttgaagccatcttacagagggactgattgacagtccagactataaaatagcaaatcggatcttaccagcttttagttaataattggccactcgagtctaattttaaataaaaatttatgaaaaacacttgagtacatggaaaggtgtataaagagaaatcagtattaagccaagtataatctaactttattgttttctttagtccactttgactaaggagggagcttgctccaccaatgaaatcttacctggaaacattaaacaaagaaaaaaaaaacccacaaatagttgttttttgaaagagaaagataaagagactgtcgtatcttatctacacaattctgtagagcattatacaaaagtaactctcattaattgaattgtatatttttaaatttccatttagtattaagaagttaatatttaaatagaaaaaagtatagattctacaaaatatacatatagacacccatgtatagacacacatacatatatatagtaccaatatactttatgtaaaatataatctgtataattgtatatatataaaatacatacacatactaatgtaatatatacatatattacatttcatatatcttatatatggtatttttacatttattatggtcaccataagagcacataacctggtttacatggaacaatgttggtttatacctgtagcactggagtgattgttgcagcatctcctacacccaaaattatcctggtataaatgataaagtatatggttttcttatgatgggaagttaatcatctcatactagactactcagtgtgcatttgttatgtttcagggaatatgccacaatcacataaaacttcacgtatctgcatggattactgcctttgagaatttttttaattatggaaatcagcaatataatatattcgtgtacaacaaatatcttatttttagtaatcttctttccaagaaataatattattaacttaataaataactaaagcagatcagaaaatcaagaatcttttctctcaatataaaaataagagtgaaaatattttatattttattaatgatagcatgaagtatgataatgaatctatgagattttgtaatatttcagccaaatgagttttatgtaacaaacatttatacttctcaagattaaagaaatttaatggatttattgtgcctaataattaaaggctgatttgataagctcagtgacttattcatttagaatacatcttacgattcacattcttatagactataatttgtcaaaataccccaggattccaaaatttacacaatttgaaatctcattttcttttattttgttttctttttcactctggtaggacctttaaagcttttcattcaccttcaattttttaaatcacatcaaagctcttagtagtaaatttaattagccaaatagtggagattaattgcttaaataatacatgtcaagatataatacccttggtacaaaatcaagctcttacacattatatttaaaagccctttctttcacatttaaaggctactataattccctacggtacctatcaacaatagattcatctatatacacatttatcctatgtaaaattaattttaaaaacacataagcaatagaaataatatcatttatgaaaaaagtctttacctataatatttttgaaagtaagtaactatcatactcaatgacaaattggaatgttataaaatgggagaatttaacaagaatttgatttttaagctaatgatagtaataaaagtatttattcagtaattgccaatttaatcaataattattctaaatgctttgcatgtatcaactttgtatcaatttccaaacccatcttatgaggtagacactattattttttctcatattctagattagcatccttttttttttttttgagacagagtctctccctgtcgcctgactggagtgcactgacgcgatcttggcttactccaaccacccgctcccgggttcaagtgattctctagcctcagcctcccgagtagctgggactacaggcatgcgccaccacgcccagctaattttttttgtatatacatacatatgcatatatatatatatatatatatatatatatatatatatatatattttttttttttttttttttttttttagtagagatggggtttcaccatgttgcccaggatggtatccatctgaccttgtgatctgcccacctcagccagcctaagagctgggatcacaggcaggagccacccttcccggacacaactttttttttaattgatcaagttttggattatcaattagatttgaacaggattagagcactagtagaacagatattaacatcagccaggtcaaaaaattaatatttccaagaaaatcaatcttttcattttatttgaatatgtatattgttaatggcaaaaataaaattttattttccctgaatcaatttttttaatatttctttttagtagcattgtttctatttttcctttgttttgtgaatgacctacaagattatacccattttttcaaatttctttagatcaattataggattaatacaattgggaaatcattatttgaatcttatgattaaactgtacattatattaaagcacatacaatgttataaagcatttaatttaaaagtagtttatataatttgttttatctgtcttttctaatattctagaaattggagaaattatattaggtcatagaattgtgcatagtaatattaatttgtgtttgttttactttttattatttatttatttattttttagtttttaaattttttaaaaggtggggtcttgctgtgtttcccaggctggcctcaaactcctgggctcaagcaatcctcctgtttcagcctccaaagtagttgggactacagatgtgaatcattgtgcctgtggttgttttaaatagataaccaggcttttaatttcttgtcacactgattttggcaggactaaaattagaagcagcctctctcctggtcttaaaatatgatggactccttaacaaaattctcccagtgtctcacagactcttctttaagggagatgaaaagtacctctgagaagaaataagctgaggagggcacatttctggagactagagagacagaaaaggtggtattttgttttataagcatcagggacttgagttttgtctgttctccagaaggacctgagagtgtaagggctgtgagctgtttctaggaagcctgagtccttgcagtatgatggatctcataaccaaatttcctatactccaaatttggaatgggaaaaccaaatgcatagaggcataagggaccatgcaggacacaacaaagtgcttttcaacagaaaccaatatgggtctctgaacaaaaggacctgacaaagtatcttcctggacttatgcacaattttagcaggccaagttgggtgggagtgagtagaacatttaatgactagatatgagtttatagccagcttgaaaggagaaattcttgaaggcagaatcaggtaatttaccaaactaaggaattaaaagatgttttcagttgtgtcagagtgaaatgcatgctgtctacaattgtgaaaaacagagatatatgtatgctatcaaaaacaaaaaccaacttttattctagagttaattgatggtatgacctggaattgaaatggtaacatcattagagatggcctttacctccttgtacttttctccatctgttctattctctgccctctaccaaatatctttctctctttactcaggcttcttttttctctgatctattatcttttcacatgtcacctcttcttaccttatttatatcataatcttccttttcccccccaatataactggcaagattcctgtagttaacaattcaaatatctgaaaaagagattctaattgattcagcccatcttgaaaaaaaaaaatcacatgcctaaggtcttgggtcactaaataatatgtgtattgactggtggtgtagcttgtatccaactctgatcaattggtattagctgagggtggaagtaaatgatttacatggtttgaacttttattaacttattcaaacaaggaaacaaataactattgaacacatattacgtgccaggcatgttctatgcacagtcaataaaatagttagaaaaacagaaaaaaactcaatgccttcaaaaagcttacatggtaaattttaaaataaccacatttaatatgttaaatatattgaatgatatttggcggaggttgcagagaaaaataaagcataataggtgataaagaggaggtgttataattttaggtagggtgaatgaggagatatttattggagaggtagtatttgaatacacaatttaaggaagtgagcaaacaagtcatagagataccaggcagaaaagccttacaggaagaatgagatgaaatatatatgtattcagatggaagtgtgcttggcaatattcaaggaatattaagaagtccactgtggctgcaatggggtgagcctggaagaaatgataggagtatatgttttgtaaatcattgtgattatcttggcttttaatcagagttatatagatagccgttagaaaatttccatctgaggatacacacatttggattttggtttgaagagatttctattctagctactattttatgaataaaattcatggggttcaggggaaagcagagagataaattaggagtttattgcagtaatttaaagcagagatgacagtgactaggaccagaacaatgagaaggggtcaaacacactttgaagttaaaatcaaaacttttcactaacagattttacatgatgtgggaataaaagaagacagtcaaagattatccaaaagagactgttggtccacgcaactagtaggagggaatagctgtaaactgaggtgggaaagacttgacagaagcagctttagaggaaaaataatcagaagctcagtttgggtcagattatgtttgagatattcaaccagagatggctaataggcagttgattatagacttcaaggaataggtccacgcttgaaaaacaaatttaggagtaattactgtatggattggatttacggttctgtgactgaaagacacaatcaagggaattcatatgcactaaagaaaaaaggtccaaggattgcactctgggtctgccagagcagagaggataacactataaagttgtacttagaaagcagtaagtaacataatgctacgtattacaatagtattttatcgaccctctttatcttccttttgaaggattttgcataaatgttttctgggtcatgatctaggtcaagcaaaaaaatctcagaatagagattatttaagaagtctcttactatatctctatatctctctgtttctttgtattaaaatctctcaaatatactatgtcctaaaagtgtgtgtgtgtgtctctctctctctctctatatatatatatatggtcagaattatagttatattgatacttatttttgattaaaaaagttgtcttttaatcaacattttcaggaaaattctatttgctagccatgacataatttaaaatataccgaaagccagtatacccattcatggtgatgactggtgcattcctgtctaaaaacaaggagtatatctcagtgtttgaggatgctatatatcacctcaaggctctcaaagtgccatccatcatcatgttgtataaaatgaaaggtgaaccactttactgtgagaataactatatagcaccacttcaaagccctaagccagagttgaactatggcaattcctccaccctcttgtcggtcctgtactctataaatcagacctatatgattgctgaaaacatcagctaaaatttacagtagtttaaaaactcaaggatagaaaaatcaaattttttcaattctcattttatttgcaatggtacactgtccctgatactactattttcttgtgttgtgtgatactttttactcttgttttgaagatcttcatgttttgtataacaacttattttgccttcataagatgttttattatttgtaatattcttatacactctactgaataaatttccaaatttttgagaggatttttttcaagttatacatatatgtaagtcaaagaaattacatttagttttgttattagtaacagtaatatgataaatagtttataatggtgtttgccctgtttattgtggatattaacagtcattagattactcaccataattaacctatgaacaaacactggtaagtaaggatggtatataaaataagatgtaagactatttcaaaaaaaactctaacaacacgcagaatagaattgtgatgccatactcacaaaccttagctaaactaacaaataacctgctattttttgacacatgtaacactacacaatagctcatttgtcatttctaacccacacaaataaaacatataaatacttatatggaagaggtaacaaatagtcttgatcaaagagctaaacagttatagatatttaaaaagtatcaaagaaaaatgaacaaatctgttggtctcaaatatagaagtgttgcatgtgtacacattgcaatgaagaagacactctttttatccaaaattatgtctgaatctttctcctacaatcagaaattctatgtggtcaggaatatggaagtaggaatgtagctttataattgatcttgattttctttggaggatcagctttcccttaattcttataatatactctgattttaatttggggtttatatggatccagcaaaatttatcatagaatgaaacctcctttagatacataaattccattgaatgatccaatgtcgagcatgttttcaaactgaaaacattgaatctctggacctttgcagtgaatgcaaaaagcaaaacaaacaaacgaattaccccacgcattttggaatcatgcaatatgcgttaaactaagcccaggttattcctatctttggacttttttttttttttgctctacaatgagaggttaatatattagtttaagatagtctaaatagagtattatttcttgcagacaggagcattttgactgatgtaggtccaccttggctgctcacggttcctgtgagatgaaagttcaagtgattgagagcagagaatccaggagaagttgggatattagagatatagtcagtacaggttactataaattaggagggtaaaaagattaaagtgagttgggcgcggtgactcacacatgtaatcccagcactttggggggctgaggtgggaggatcacttggctcaggagttcaagaccagactgggcaacatggcaaaaccccatctctacaaaaaataaaaaaaattagccaggcgtggtggcacatacctgtagtcccagctacttgggaggctgtgctgggaggattgcttgaacctaggagctggaggttgtagtgagatgagatcgtgcaactgcactccagcctgggaaatagagggagactggcaaataaaaaataaataaataaaaaatttaagaaaaagagtatagtggaagtttttttacataaaggggaaggcagtttacttaaatgcaaagctataaaatatgctgaggtaatccttaggaagtcaagagctagtgaactgttggtttttacttcaaacagaaataattaacctaagctaatatagttattaacattaaagcctcctgaaacacataaataagtacaataaaactaattatcaatggcttaagcaaccataaattatacacacacaaataaatacatactatttttcattgtatatttaattctttttaggacaaaaattagtggtttagttctacacatgtacttcagcaataggaggcagtcatttctatttcatgtaaattaattaccctagggcattgagaatgctcccagggttgcattgttataaataatagcttcattgaaaacacatttaacctgaatctgattatttcattggtgaatttctacacatgaaattgaagggtcaaagtctttgttttatatattttaaacaaaattatttaagtctgtgcccacaggtcaactagagagctgcctgggcaggagtcattatagaaataattgtttaatacatgttttgcaatttgaaaatcaaaatgttatatttctttttatttttatttgattctcatcagctaaaacttgaaccttttatttataatattataatttcttatatcatacaattgaattgtaagcctaagtcaaaacaaggtctttgaagtctgcttggaatttttgataatgtagggcaattattacaaataatacaaaaatttccatgagtatttttaaaaattttaatcacacaaggaatacttgggcccacatgctgtactagaagacctagttatatatctgcctctgtcattgtcccatgcttccctttccaatattatagacatttagctatttaaatttaattcaatttaaaaaatacaaaatataattcctcaatttcacaagccacatttcaaaggttgaatagactcttttgtctagtggctactatatgaatacacatatagaatatttgcatcattgaagaaaaatatattggagagtgttggtcctgttacgtgtgtttgaaataacacacaaattccattcctttttcctgtgctttctttcattcattccaacaataataacaataataacgaggccctaatgcttgctggagacaagaatttggtaatgaacaaacaaacccctggctttgtgaagaaaacaaacccctgctcacatatatggaagggaagtaaataagtaaacacacaaacatagtgttttatagtaagaaatacattaaagatactaaaatttagaaagttgtattagttaagcttgtctgtgaaatataagaagactatcttggtagagacttaaatgaagagaaggaaaataaaaactttaaggatgtctgtaaatgaaacattccctgtggagggaatagtgcaaatgtgctgagacagggtttttcttactgtgggtcaaggaagaacaataatcccagtgtaactgaaaggaaagaatggtatcaagggccagattacctccatgctgcatctttgaagtcctttaaaggattttggattatacaatgaaataagagagaaagccattggaaacttccaagcaagaggtgagtaatttccttattaatggcatcattctgtctgtcttgtggagaacaaaacattgtggacatgagcaggaatggaaacaaagctaccagagagatgactgggcaggagtctaggtgacagattgcatggacttgatcaatctggcaacaatggaagtgaggagaactattgggtctattgagaatgatgcattctctactggatttattatgtctcccatgtttcttctgtagtcatggaccaggaagacagtgtccagagacttatattgtgctagattgttatttctgttgaggtgtgaagtcccagtgtcctctacctttcctaatcaccagtgctagaagaccctgccaactctcaaaagcactgggctgtttgaaagtaattccagaaccaatgttcatagctaaacaatcatgaacaggctcaagaaaagaatagttttcatgtattttttcattaaaatatttttctagtcacattgacagacatctattcacatcctgtatcttaatgaccatttttctcttgccagttacaaaatgactgcttcctggtgctcttgttttttcaagatataatggttaccatggatacatcaatagattttggatattttgctttttagctctgaaaaattacctcttctcacagcacataacatattgtgtaatgaaaatgaattcaatgagagatcaaatggtaactaaaaaaaagatactatgaaaatagtacattaatagaacatttgctgtaaatacgcaggttcaaatgctcaaagaatcttaaagcaaaatatttataaagatttttcattttcattatcctattgtaagataaagagagtcatggcagaaaagataatctggctgaatccctcttttggaacttttgccttagagagagagcatgcaagctataaagatatctacaaatattttagtattaaataagttgaagagtttaactcatggagggagattccaataactatattgttatcagcttttttttacttcctttctacacttggtataataatccattccatgatatatataatctggtaccatccaactcactctactatcctttcacccagctctaagccacttcctctcaattttctacagaagtaacactcaatccctttcaccatttttccatatagcagacatttaatgttttagagtattggttccagaattgattctgacacaactataaatatctccaaggaaataatttatcatgaatgcattcacacacaggtgtgtatatgtaggggtgaatatataccatatataaactcatatatatatatatatatatatatatatatatatatatatacacacacacacacacacatacatacacacacaaacatacatacatatcattatttaaatgatctgagtactaggaagcctcctaggccaccagggaggtaggaaagtgcgaatgggtactttagaataatgactaattttcaaaatcctttttttcttaacctcctcttctaaaagagaggaaagataattcagagcagagggaagatagataaatagattattatgactttatggagagaaatattagaaataaggagaatgaagtgatgaagaaacagaacagtactgacattctagaatttccacttctagacatcaagtgttcaaattgagcattctgttcatcgaagatagaaaatggagttttaaaaaacaagcaggtgctgacttttactagaaagtgtcaaatcaaaggattttcactgataatttttttcatgttattaaacctaaataggaaaattttctgagaattttggtgcagctctaaagttgaaaaattatctgaatgttttatttttcttttcttgtttttttacacagtatttagtaacatgggaaattctcacacaactgtttggattctaccaattggctcttctcaattgtttaaaaataaatcataacatatctgatttaatcatatgtttttaagtacgtgtggtccacatgttttattatttcttcttcttcttcctcttcctcttcctcttcctcctccccctgtctcctccccctccctctctccctgcttcctccccctctccctcctccccctcccctccccccgctgctgcctcctcctcctcctcctccttcttcttctccttcttcttcttctgccatgtgttagacaaatttaaacctacctaaagagtggcttttcttactgtgttttctcctaatactgtctctgcattcttccaaactactttcaaatttaaaatatcttatatcttctcattcacttctcctccctttatgcgtgactcatgaatacatcctttcaatgacaatttttctatttgaaattggcttcagaggaagaaaaaaaataagtgttgtattatctcatacttttcaactgtattcagtactaaattgatgctttttcatccacgattctattcctactaaccttataagtgggacataatctgtgttttatgcaatttccattatatcattgttgctcaagtaatctggaacataaaacaataataaataagccttctctagggattcaacagtaatccgctttttcactctgataaaattaagtctttataatcccctttttgtttcaaattcaaaccaagccacttcaagtctctttattgtcattgtttgctttctccactgaattcaactgtttatctctttgtctgagaaactcatttattctttcgcttgatattggttcttttcatactgaccatcctaccatacactgctcccaaatctgtgctaatgtttgcttttcaaggaattaatgttttccctttcaaataatgttaaagttgctttcatatgtaatttaatcttctcctaagtagtttccttgattcaacatctctgcgtgttcctgaatgttaagtctcattgctctcttgtcaaaattcctattattttacaaatactgctattattacaagtacaataatactaataaattttgagaggctcttatgtgccacttgtggtgctaaatactttgcatgtatcaattatgtgcattctctccctaaacctttgcataaatattcatctttttattgtttatcagtgaaaatcggagctgaaaatgttaattactcaacttcaaagagctaatgttggtgcaaaaataattgcagtttttgcattgttgaaatttaccatttgataatggaatacatttttgaataaatgtggttatattatacatcactttaatatgtgtttatcactttttttgctaatggcttattacttgctgtttattttatgtttattttagactatggaaattttgttagacaaaaagcaaatttgagtgattttcttattcgagttcaaaaacgggttgtaaagcagcagagacaacttcaaacatgaacgatgcatttggctcaggagttgctaataattttacagtgcagtggtggttcaagaagttttgcaatggagatgagaggctgaaagatgaggaacatagtggccagccatcagaagttgacaatgagcagttgaaagcaatcatcgaagctgatcctcttacaactacaagagaagttgccaaagaacacaatgccaaccattctacggttgttcagaatttgaagcaaatagaaaagtgaaaaagctcgctaagttgttgcctcatgagctgagcgaaaatcaaaaaagtcatcgttttgaagtgttgtctcctcttattttaagcaaaagtaaggctccatttctcttttggactatgatgtgtaccaaaaagtggattttatatgacaaccggtgatgaccagctgagtggttggactgagaagaagctccaaagcacttcacaaagccaaacttgcaccaaaaaaaggtcatagtcactgtttgatggtctgctgctggtctgatccactacggctttcttaatccaggcaaaaccattacatctgaaagtatgctcagcaaatctatgagatgcaccaaaaactgcaacacctgcagctggcattggtcaacagaaagggcccaattctccataacaacacccgactgcacattgcacaaccaatgctttaaaagtagaactaattgggttatgaagttttgcctcatctaccatattcatctgatgtctgaccatccgactaccacttcttcaagcatctctacaactttttgcagggaaaacgcttccacaaccaggagaatgcagaaaatgcttcccaagaggtcgtcaaatcccaaagcacagatttttacactataggaataaacatactcacttctcattggcaaaaatgtgttgattgtattgattcttattttgattaatatagatgtgtttgagcctagttataatgacttaaaattcatggtctgaaaccgcaattacttttgcaccaacctacaaagtggcagagctaggatttgaagtcaactggagaatgttagtggaaagagcaagtgttggttattaaataaaaaatatcctggttctagaccagaaatttgagagaaattttacagaaattttacagaaaaataaaactgatattcctaccttaaaggcagtgtgtgaaagagcaggcaagtgtatacagtatctctttgtcaactttagatctgcttggcctcacatatttatcataccaacagttgctatagcactgagtcctgtgtggactctaataaagttcaggcagatgcaacctgactgagtcttgtttcataacctcatcacacatcacataccttgcacttctacctcaaaggctcttctgatgatcataaagcacacaacagtacaaaaccctccttggtgcctaaatatctacgattgcaggagtactgtcccgtgggttgtatatttgatcaatgaaaatgtgaaagtgagtggataaatgatttcctttctctcttataaaaatcttgttctaacatcattatttgtcttaccttcttggacactgcttgtattcagcagttgatagctcagagacgattctttatatttgatcttcatatttccttgcccaacaccccttcaccctcactcctgatgcctgagattcctaatacaacttatgccctcgtctgatttttggggaaaccaagaatagagttggagccacatagtgatagtttattccaaaatatcactgagtaaagtaaaacaatgagacatacaatggtaattatatctcacagtaaactagatatcatatccagattttgacctcccatcagtttggatacctgtaaccaacctctgcctctatcaccccattactctgatccctgaaaacaatcatttgatatatgtggagtgagagtcaaatataaaatgtttggtttgtgtcacacattgagcttaataatgagaattccgaattaaatagggcacaatcggacttaaagcagctcagggtacaatagagaaacagagatgtcaattaataaataacaatacaacaggataagtataaaagtttgggttaccgacgacctcatattttctcaaatcattttcctaatattcatcttctacaacactaccaggtagatttcaataagataattatccttttattcacataagtcataaacagtttataagaatatgtgttaaaaatataaattcctgagtctatattcctgacttactgacttaacattcatcagtgaaattcagacaattcataatagggctgctttcaaatcctggctgtgcttcagaactagagagctttttggttggtgattttgtttaattttaatttttaaattaacataaaataaaatatttttgcggaatgtacagttttataaatattaacacaagtattgatttgtgaattgtgaatctaccaccaaaatcaagacacagagcaattctatcacggaaaaaatcactcaggcttaccctttgtagttacacctttctcccatccttacactctggcaaccactgggatattctccctcccaataattttatcattttgataatgtcatttaaatgtaattggaaaggaattaactttttaaagactgtcttatttcatttaggagaatgcctttgaggtttacccaagatgttatatttataaatagtccattcatttttatttctgggtagtattccaatgcatggaggtatcacactttacttactcattgccccactgctggacatttaaattgttttcagtttttgatgattctgaatagagctgctacaaacatttgcatgtagatttttgtgtgaaaatcagtgttcatttctctagataaagtaaatgccgaagattggattgctcggtcacatagaaagagtacatttaactttataagaaagtgatcgagtgttttccagcgtcccaccagcattattcaagtattctcatttctccacatccacatcagcatttggtgttgtagttttgtttattgtgtgtgatattctcataagtatgtgatggtgccgcaacatggttttaatgcatttccctgattacttatgttgtcgcacatattttcatgggctaatttcacacatttatatcttcctgggttaagtgtcccaggtcttttccaatttttaaaaaactgaatttttactttgtttctatttgttactgtcgagtgtttcgagttcttaatatttttgtatacaattctcttgttaatatgtgacttgcaaacgttttctctcagtttgtagcttgtttcctcttaatagtgccattcacattaaaaagttttctttaactttttaaaaatgttgattactggtgaaagatttaaattatacacattatagtttccaacccactttgacctactaatcataacatctagatgtgacatccaagaatatatattttaaaaataaaactttccatgtgattcttaacctggattaacatgctttattccagagtaaggtcagcaaataatatgccaagacatattttcctacacacccttggctactttatcgaacatcacagatttaacaataacttctctgtttgtaactctgaaatatttaatgttcttgatctctcataaaccaggtatatgctggatatgtagctccaactacattctactaattccgacacaactaattaagtgttcaacaatttgaagtcattattaactgcaaattgctgccctgtgttcagccctttttttgttaatttctcaacacctagtattataaaaaaattgaaaactaataaaagggaaagaaataaaaaaagaaagatgaaagaaaagaatgagagagggaaagaataagagatgggagaaaggagagtggcaaggaagaacacaaagaaaaaaaggagaagaggaaaaaatgaaagaaaagagaataatagtttacagttctctttgatcctccactatttttgcctcaaacagtggttatgacttgccactgaggagctaatattggtaataggatggacataaaaaacatggcctggtaagttttatttttgtttttgttttttctgatctcatcagcctgaatcagagggatgataaaaatttaaatatctataaaacaaaggtatgctgaacaaaagaaacacagaattgattcgttcatttattcaatcactcatttttaaaaatatttaagctctatgaaattgtgtattataaaaataacagacgttgtttactagatatctggaatgatactaaatacttttcatttattaaccaatttagttgttataattaccctgtaagatatgtgtgtgactatatttatttttcagatgattaagctgagacagacaaataagtaacattccgagattacatcatttgtagtagaagactcaaaattgtattcagtgttctgtttacttccaaggcagtgcatttagctatagtttttggcctttgctatgattccctttgtatgtagattaaaggtacacctctacttttcatattctgaaacttcaaggaaagttctgcaggcaatttaaaaatgaggaaacacatagtgccctgtaacaccaatatgttaaagattagagaaaatatgtgtagagaaaatcacttgaacagtttgctctgtgagcaagagtacatagcaacaagtacaaatgtgtaaaaataaaaaatcgctgggcagtttaaccagaaaaagatgtaaacaagtcaaaagcttaatactttttgaaaaatgaaattatattgaaaaattcaaacatgaataaatctatttccttaatcttatctatgaaacataaatatacaacaaaagtatttagaatattttttaaaccactgcattaaaaaaaataagattctagaataaaacacagattggccaaactttttaacagaattaaattgtgtgtttccctgcacttttttagtgtgcaacaaagaatactacacagaattaaatctctaaggtagaaactttcaatagaaggaagtgaggagtggactgtgagggtcaattccgattctaccatcagttagctatgtcatctggttttatttattaattatcttattatactcaatgttttttaagtgtcagggatagtagtaccttcctttagagatttttgggaaagattgaattagacagtatctataaaatgctctttgtagtatctagcacataactacttctaataaattgtagcattaatttattctatatacatattcatctataataagacttatctcaggttgaccagtcacacattaatataaagcatatgccagcctatagagattgtaagaaaacatacttttggtggtatttgtctgagctttgttaatcctaaataaaaagtgctcaaactcaatacatctctagtttctactgcccccatacatttcagtgtttcccaaagataaataaaatgaattatatgataatcatttagatcctaaacatatcatttataaaccaacagagatagcaagcacctggtgccaagaaaatcactcttattgggtggatttccatttgcagagactgagaagaatattagcataaagcagcccaacacaagagtaaaagctattttaatgctttgaagtgggggtgaagagctctcaaatccagtactgggtttattaacaatcattggcattggccctgtaaattataagttacgcatacaaggaatatatctgtaaactgaacacttctttcactccttaaagggtaccttgaggatgataatgcaaaacagtgaaatttagaggaaacattttgtatgatttgaataatttgcattatttgattcaggcatgatttgaatgatttgcatgattctctattagcaaggatggtagaaatgttagttatgtaaggttaattatatgtataattaaccaagaataaaaatgaccttcagatagtcttatttcagcaaacaatatgccaatcatttccatttatcattcctatgaatgattcttctaatttgtctttggtatcagatggtattacactcacaatacttagttatatgtaatcatgtcctactatagtgaatttcaagaggatatcagcatatctcacagagtgtagttgttgtaataatataatagttgccacctaaagtaaaagcaatctacttttcacattccaactcttatcttggataattttaataaaattataaatattcccattttgcagtagatggaattttggtttaaagaaatttaatgactaatctttgcacatgtgttaacagttactgccacccactgacaccgcaactacattctgaatgttgaaacaaaacaggcttatttttgccagagatgaaagttgcttattagtttgcttttcgtaatagttccaatttactttgtgtcatttttaggaaaaataagtgtcaggaaaacaacatataattatttaaaatattttaaggaccatgcatgatggctcaggcctgtagtcccagcgctttaagaggctgaaatgggaagatctttcgaggccaggacttcaagaccagcctgagcaacatagtgagactccttctctaaaaacaataatttataaaaatataactaggcatagtggcacatgcctggagtcctagctccttgggaggctgaagtgggaggattgcttatgcccaaaaatctaagctgctgtgagttagggtggcaccactgcaccccagcctgggtgacagagtgagactgtgtttcaaaaaaaaaagtaaaataaattagttttttttttaaatggcacaagtatactaaaatccccttgtgaatagtcaatatatccattacatatttgagtttgtataaattttaaaatgtgctataattatgctccatatttatcttctcttcatgccatcctttaatgaaaatttagctgaaattcttaagacagttatgtttttgaaaattataacaatttttatatgtgctgccaaagcaagcatagtggtgaggatgtggaaaaatggcaattcatgtacactattggtggatatgtaaattagtatagccaatatgacagtatggcatttccttaaaaaaatgaaaattgaacagccacatgaaccagaaatcccacaactgggaataaatttaaaggaaatgaaatcagtatgtcatagatgtctgtattcccatgtttattcagcattattcacaatcaccaagatatatattcaaccaaactccctatcaatagatgaacaaataaagaaaatgtggtgtatatatatatatatatatatatatatacacacacacacacacacacacacatatatatatataaacaatgaaatactattcagcttttgaaaagaaggagattctgtcattggtgacaatctagatgaacttgtagggttttatgctaagtgaaataagccaggcacacaaagacaaatagctcaggacttcacttaaatgtagaatctaaaaaagtctaattcatttaagcagagagtagaaaggtgattaccggggctgggaatataggaaaggaatgaagacacattggttaaaggttacaaaaatttcagttaggaagaacaagttctagagatctatcaatagtaactacagttgataacaatatattgtttacttgaaactttcaatggagcttttaaatgttctcaccacaaaaactgctaagaatgtgaagtgatgaatatgtcattccaaaatgtatttattcatcaaaacatccccttgtacaccataaatatatataatttacatttgtcaatttaaaatataaaaattgtgtgtatatgataaaatacatgaattgtgtgtgtatatatgataagatgttaaaaaataataagaggctatcttcatgaccttaggataatcaagggtttattagaacacacaacatgccaacaaggagaaaaatcaattaattgtacttaacataattaagagaccattaagacagtaagtacaatgacaagccacagaatgggaggaaaaaaattgtatatctaggaaacatatgtaacaacaacaaaacaacaaaggcaggtaatgcaatagagaattggggaatttgagcctgcaattcataaaagagaatacccaaatggataatacacatatataatggggctgaacttgattcattatcatagcaatgcaaattaaaactacaataggatatctctatgtactcacctcaaggctcaaacaatgaatggatattctattctatgactagatcttgtttacagcagaggtagagtatggattggtacaatcactctgggtaacattttgacagcatttaacaataatgaacctacacatttctcattacttagaaattctatatctgttataaaccatacaaaaatgcatagttaagctcatgaaaagataagcatgagaatgttcatagaatcacttcaaaatatctcaaactggaaacaacccaaatacgtattcagaataaactgatgaataaatgatggtatattcatagaggagaatactacatagcaacacgaacgaactgcattttctgaatggaccacaattgcaaccaaaaacatgaatgaatccccaaagtgtgttgagtaaaataagccactcacaaaagagtatatattgcatgatatcattaatataaagttcaaaaataggttattctaaggtgttagaagttgtaacagtggttatccttggtggtggtggtggtagaataaaatgagattagatacagcccaagtatgtgcttcagaaatgctttgtttctttatgtggtgctatttacagtgatgttttttattttctaaaatttcactgggtgtgcccttgttaattatcttctttttataaaattaaactaattgtataaatagtcaaacatactggaaaatcaaatcatagctagccatgattctcctctgtagtctaacgaacttgtaatctataacactgaatattctaagtaaaacgattagaaatttgataagctttttctaacatgatttttcattaggtacaagctcatattgtttactctgctttgatttgatttaaaaagtttcaaaataacctgagtgagataaaggaattatttgatagttgctaatcatagaaaatagcctcaaatatatgaccaataataatgtctgtggaaatgaaatggcatagaagataaaagaatataggaatgaagttcacttcataaatatgacataatttgaattattgaaggtgaaggagtttttactgtcatttatttatatcttttatctttcaagccttactatcagaccaataggagcaaaaggctgtgatatttcattacaaatgtacagtgttatatagaatacaggttttcatttattattcttaaaatgaatacccaagatcatataaaataattcactttgaagtgaaggggggctaaataattcatgtattacgtttaccatggaccttctctagtctgcttgtggagaaaatctcctttcttggatgagaaattacattggaaatatataaacagcggcacagtcatgtgatttcttctgctcaccttaatagaaattagatgcttatatcatctgtggctatttaagacatagtattgaccatttttccattggtcatgtttctttcatgatggaaaaataggctaacttacttaataaaagagaaaaaaatgtctgagatttcaacccataaaattaagcacttctctttaaaatatttttatctaactctcaataagcctaaaaaactactcgtggtacttttttattttgcagaatttcattattttatttaggaattcattacagaaatatttatggcacattcataccatgccaggctagattcttggaatacagtgctaagctctggaaaaacaaagaacaacctttcctcaagatgtgtagtggaagagacagatttttaagattgtgccagctattaaagagaactaatcagctcccctctaaatgtgatctagacaaacttggagaaaatgacactgtagttgatttgaatgtgttcccacctaatttctcttaatggtaatatcttgtgtaaatatagtacagtatcacaaccatgaaattgatggatataatttttggccttaatcagaattcatcacttttacatgcactcgtgtgtgtgtgtgtgtgtgcacatgcatgtgtgcatgtttaggtctatgcgattttctctcttgtgtagattcatgtgattaccaccacagtcaagatacaaaagagttcctcgtgatgtcctttaacagccatagctacttccttgctccccttcctaatctatagaaatcactgaattcttctttatctctataatttggtcatttcaagaagatcacaggtgtgtccaatcttttggcatccctgggccacactggaagaagaattgtcttgggccacacataaaatacactaatgatacctgatgagctaataaaataaaataaaatttctcataatgttttaagaaagtttacaaatttgggttgggccacattcaaagctgtaaagctgtcctggaccacatgcagtccatgggctgtgggttggaaagcttgggttaaagaactggagtcatttcttatgtaaccatttgagatagacttcgttttcactcagcataatttcctagagacctatccaagaggtcttgcacatttcaatgtaccgatgaatattcagtacattcttacatgtatcaatttttaatagctctttccatgtcactgttgaggagtatttaatggcatgaataaatgtatattcagttaaacacagttttaccagtaaaacactgaaagacatagaggttgtttccaattttaactgttataaataaagtgactatcaatagtcacatatagtttatgtgtgaatatcagttttattttatttgaaataaatgccccagattgtagttgttagatcatgtggtaagtgtatgttttgtttagcttcattagaaattgacagttatgtacagtaagaacactgacccactatctttacattttctagtaacacaatatatcatcattagctatagttaccaggctgtacaatgaatcccttgaacttatttgatacgtttcggcttttcttttttctttttttggttgggatgtggggggacggaatttcgctcttgttgcacaggctggagtgcaatggcgcgatatcggctcactgcaacctccgcctcttgagttcaagcgattctcctgcatcagcctaccaagtagccagtattacaggcatgcaccaccacaccccactaacttttttcatattttagtagacacgagatttcactatgttagccaggttggtctggaactctgacctcaagtgatcagcccgcctcagcctcccaaagtgctgggattataagcgtgagccactgtgcccagcctgtttttgtccccatccaaatctcatcttgaattgtaatcctcataatccccatatgtcaacggagagatcaggtggaggtaattgaaacatgggggtggtttcccccatgctgttctcatgatagtgagtgagtgagttctcacgaaatctattggttttataaggggctctccccactccgcttggcactgcttcctgccaccttgcgaagaaagggccttgcttccccttccccttccccttctgccatgattgtaagtttcctgaggcctccccagccatgctgaactgtgagtcaatgaaacctctttcctttataaattacccagtctcaggcagttcttcatagcagtaagcaaaacggattaatacattattcctcatatctaagtcattacatattcttttttagtggatatagaattctggcttcacagttcttttctgtcagcactttaaaaatgtcttctggtttccatggtttcttctgagaaatgtacagtcattgagtcattgttctttcgtatataatgtattttttttctggatgtttacaacatttatttatatatctctggtctttagcagttttattgtgatgccatgggcatatgtttctttggatttcccttgtttggttttcacagaggcacatggctatattattttgtgtcttttgcctaattagaaagttttcaggctcatgtcttcaatttttttctgttccataatatttatccttcttttctgagatagtcatggaatgaatgttagaccttttgatattgtcctcacagattcctaaagttgtgctaaatttccatgcagtgtttttccctagtcctatagattaaaagatttctattgatgtattttcaagttcacacattctgccctcttttgtctcccttctgctattgagccctgtatttttaataaattaaaaatagaatacaatacaaaatatacaattttttgtcaattataaattttttgtcaattataaatttttcaattggttctttaaaaaaattatcttatttgtctgccaagattttctgtctttccatgtgtttcaacatgttttgccatgtcttcttggagcataattatagttattcctttaaagttatggtccagtaatttcaacatttttttcttctcaggtttgacatctgttgattttctttttccttgaaaatgtgtcagacttcctcaattctttgtaagttgtgttagccagaatagaagatggcccaccatgcaccccagggacagacttaactcattgtttagttccttcccacagtaggaacaatatgtttaaccagcagtttgcagcaggtttgatgtatgttatttctaaagtgaagttataacaagaccctgtggtttctatgttggacactgtccttctcctttccccttggatcattcactctgtggaatgcacttgtcttgtcatgagcagctctataacaaggagctggagctttctgcaaataaccttgtgagtgagcatgatcttcccacattaatctttcagataatggcaacctagctgatatggtttgggtgtgttcacacccaaatctcatcttgaattataactcccacaattcctacatgtcatgggaggaacccagtgggaggtgattgcattatgggggagggtctttcctgcgctgttctcatgagagagaatgagtaccacgagatatatggttttaaaaaggggagttcccctgcacaagctctcttctcttgtttgccgcaatctgagacatgcctttcaccttccgccatgactgtgaggcttccccagccatgtggaactgtaagcccaacaaactctttcttttgtaaattgcccagtcttgagtacatctttatcagcagcatgaaaacagacttatacactagatgatagattcatgagaaactcatgagatacttcccattgtatcctatcagtagttccctttccactccttagattagaaagagaaggcttcatctggagttacttactcatgtctgtacccagtgaatagctctaggatttatcctgtcaagagtcaaagctaggagatatggaaggggtggagaaactcatcatcagatcatttgtactttaaatacttgtttcttacccaacatgcctactgtctcttacttcttagagtactgaaatacggactgcatgcattttcttcgtaaattttagttgaaattagtgacaatagtagggtgaagtgggctttttccatctttcctggaagtagatataagattttgtttagttggttgctttggtttgtttgattcctgctttgttttttataatagagtgataactttatgaataagaccaataaagtaaaacataagcaattctgctgacttatttttatatttatttgtagaaaattataaatattataaacagttgttcccaaacaataataaatttgaatccataatgaaactattaacattcctatgtaccctggataataaaatgtttcttttttacttctctagattatgagagaaattataatgtgtttacaaccctcagatatctgataggtacctgagagatttttcatagcaaacttcaataaattgtaacactcttataagctaactatagtaggctgaaagaaaatacttcgacagaagttaacaaaccatttttaggatgcatagacaattaatgtagaatgttcactaagttctgacaaaataatccttagcaataatattgatttaataaggtttatatagcaatctttttacctatgtagctcagaagtactgtagcagctgacatctactcaattagtttcgattttacctggcagaagcctaaatgcggaatttggcacttaaaaaatttctaaaatgtatctattttctcaaaagtgttcagttattgtttttaatgggtgtttgcatgtgtgtgtgtttcatttgtttgcgtgtgtgtgtgtgtgtgtgtgtttcacttgcttggttctatagaaaatttaataggagagttagaggtagggtgtttatttttaacattttatatgtcctttcacccctccattctctgggattatgggattacgggattctggggaagtgaggtctacatcatcttccacatatcactcagggtttgtgaggttttcccctcttcttccttccctctcccatattttctcatttggagcttttatagtcttacctttaaaaaaatgcatgaatagtttccactgttaaaataaatctttaaacaaaataaatttaacagagttaatttgagcattaaagaattgatgataaagcagcactcaaactggaagaagtggccagatgcctcggctcacacatgtaatcctagaactttgtggggctgaggcaggagaatctcttgagcccaggagtttgagaccagcctaggaaacatagggaggccccacctcgccacataataaaaaagttagttggacatggtgctgcgtgcctggagtccctgctacttgggaggctgaggtgggaaggtaacttgggctcagaaagtcaagactgaagtgagccatgatcatgccactgtacctcagcctgggcaaaatagtgagaccctctctcaagaaaacaaaacaaaacaaaacaaacaaaagacaaaaacaaacaaaaaaaagaggttcagagatttctattttaacataatgagcagaaggctttcataggttgaacacagaagcaaaggaaacatttgattggctacagctaggtgtttgccttatttgggctggatccagcaggaagtccctagttagagaaaagtggacagtttctgattggttaagcttaagttttgttttactatttacctcagactttagttttcctacctaggaacccaacacattggagcaatctgagcctttaaattaattttttaacactgtttatctacttatttcttccaaatacaggatttctcaagagtaatttaagtgtaaaaaatctctggcctcccattacacacacgcttttcttttgacagataaatattaaaactacttaatcctttagtttttgctgtatttatcaattatgacttataataggatggtccaataataatgttattaagtatagtgcaaaaataccttagggattaaatcttaaagcaataaagacagaatgatatttattctcattctctctcactctccattttatttttatgaatagacatagtttttgtcaatgatttcatgtaatcaacaatggcaaggaaccaattttcagtgtacacataacatcattttatattgtttataaataattatttttcttagcattgccctaacataggcatgtgagcataaatgcatacactacaaatatacacacagcctctcaactgggtttattttgtaaattaaaaataaccacatataaagacccctgagctgaattttcttataaatcacttaaagttattctggaagcctaagaaactctgacactctaggtgatcttaaaatatgcctgcatttaagtttgattgctctatctgtagaacaactatctcttagagtcactgaaatgtgtctatgtctgttaaagtacacagtctgaaatcttagagttacttgccattatttataatttgtgaaatggacagctaataatatctataacactggtagttctaagaataatgccatatctacacagtaagacttaatgagtattggctgaaagccctttaagtaagtataatgtactttttccattgctacgaataactcctaagaaaatgacactcttttgacacttgaatcagctgtagctcactgaatgctttactgaaaccatacaagtgtattttttatatgtaagcagaaaactacaggttgcgtaagaagaatatgtgttgagatcattaattgagaaagcagacaatttttttattcttttggtggttataataaccaaagtgtctttataaaatcatttattacttattatgcagcttggatagtcctgatctcatttttgggaccaaaaaaaaaaaaaaaaaaaaaaaccccagcaagaacattgaaacatgatcatagtcagaaggtcaattccttttcttatcctcagtttcagtttttcagtttctattcatatttctcacagcaccaaatctctctgtaaccttatcaactaaagcaagtataggatattgacacagagacttcttactgcctagagttctcagtaggaaatccagcatttcagctaaaacataaaattgttcataatgctaggtaagtagtttctgcacacttttaagggtaatttcacctctatcaagcacctggctctctaactcaaataaaattaaaatttatcacaggtctctgaatatatgagccagatagaaatcaacaaagtgtatattgagtacctacagttggcaagactagatgctattaataagtataaaaacaaaaaagtacccttggtcacagtggtgcaagagcatttatccaagagtgacaatggaacagattaactagtattttattttgcaccgtactaaataaattaaatgcaccagactatacaaatacattaactaaaaatataatctaaaatgcaacagaatatcctataattcctgtgttttttaaccacagattaattcctaaagttttactttgatacctacaaatttaaagttagcagccacctatattaagacttcttccacaggcatgtgagatcatattatctaatgccttgccttacttattcaacagtcatgcctcataacccagaataaacatgtaattggtcagccaattgtgtacaattttcagaatgaaaaaaagaatattaatacttccattaggaaaacagatgtaaagagggtctgtcctggactgagacacatgcttattccaatgaactggtctatctttggctagaaagcaaaatggtcaagtaatggcaatagcttgaaaaaaaatcagggaccatccatcaaattatataacctaaattttaaatgatcacagaaaataacttgaacatatttcaaatgtttagcatttttaaaagatctgatatccacttgtagggagagtctgtaagtaaccaaagaacctcaaaaatctagactattccttaaatctcatgcacattaagcttctcattgtctgtttgaaataaatggggaggacacagaggccttcacataatcactaaatgacaaagaacagatgtgaaccatttacgggtaaatgtgcacactggcaaagaaaaaacacaataaaacagcatgcattgaaccaaccagattggcttttaaatgactcatacttgtgtgattgctaaagacagcaaaaaaaattaaaaagctcacttgactagggctaatacacttcagttactttaaattaaccactaatcatgcctttttcttgtgcatttctttttgacagccaaattgaaatatgcctttttctgaatttataagaacaaaaacaactaatgaatcgcctgttaggtcattattggttttgcaaccaactgttcttctggataaaagtaccctttcttaattataaactgtctattcagaatcgcttctgaagttcagagtcctaattaatgttatatttagtgatccttacaaattgcttcttgttttatgttagtatcctttttatattttgaaataaagcaggaatcatctctttaaagtaaatcagaagtgtacctttaagccacagttgctgagcaggccaactctctttcttccgattatcttcaaactcacctctactatggttcacactatccctaacatataatccatccaattgactcactctgcagtagcatagctattacttctcatgccaaacataggtattggtgcccaattatattatcacttcttgaaagcaaaatcaggtcctgacaaatggcctgtaactttgaggttgcatctgaatttgggtgtgtgacaacagagaaaagctagtagctcatttttttgatttacgaaaatgaagacaaggccaatcttttcatgagtttctattgttttgttgcatcatagttttagcatggtttcaaatttcatgtaagagggtaaaatatagccatgtaaaacaatttaaggaaaggacaatttttaaagataggatagagatacggagagtatagattaaaaggatgagaaattaaactcagagaagttaattatagggagactactacagactgattattctcaaatgtgatctcataccagcacaaattaccacatttctggcaacttgctaaaattaaaattcttgagccttaccccaaacttcagaatcagaaattcgtggaggggccttataatcacttttaaaagccctctagctgattctgaaggatgctaaaaatttcagaaccactgcaatagtgatatgatttggctctgtgtcctcacccaaatctcatgttgaattgtaatccccactgttgaaggagggaactgagggaagttgattggatcatgggggccgaatttctcaccttgctgttcttgtgatactgaatgagtgctcaaaagatctggttgtttgaaagtgtgtagcacttcccccatcactctctctctctctctttctctcccatggtaaagacatgcttgcttccccttcacccttacaccatgattgtatgtttcctgaagcctcccagccatgtttcctgtatagcctgcagagctgtgagtcaattaaacctcttttcttcataaattacccagtctcaggtagttttttatagctgtgtgaaaatggagtaatacaaacagatatgtagttttcaatccaaataaatggaaaaaaatttaatcagttactaagtaatatgttttaatatcttaaggaagtatgtaggtaaaggtggtaaaaaagtaaattcatgtttacattaagattttttaaagtccaaggtaatttctctaaatagaaagttgcattgctcaacttcaaacagattcatacaagtgagctggaagcatagaaatttagatattttaaagaagaataatttgaacaatcatcagctaattgtttcaattaaataaaatcacaatagaaacttaatataatcatcccatccatgctcccatttgatcttcataacaaacctggaaaatgtatagggcacatatttattatttttctacacttatagagaaatgcatttactcaagattctctagctcttaaatgtccaagctctgaaaccacacatttctcattttaattcaagttttcttcctcttgtttccacctgcacacccacccatatggcaggcaccatgctaagaacttagtttttgcataggagaaatatggggtaaaatctttcactcttttgtagaaaatattaaactggaaatatatacaaaaactactttataatcccttaaaaatcaaaaaaccaaaggatatcttcaagattattacaacccagttaggtcagtaatatttagacacatagacatgtatgaacagtgtgcatgagggaaaatagtcaaagctgtatgtattctagagaatgatgctaagtagaatcagagcaagaggaggcttttcacatgcttcatccaaattccaaatccctcatgatgaggcaaagccaaacttaagccaaattgataatgtgtcattatacctgtgctcatgcagctctccttccaaaatcttcaaccacttctctcatatcaccagggcctcttatgaagatgcccttctgacacatcatttctgtaatacatagtcttctcccaagactttgagagtactagacaagcaatggatttaaaccaagttggaacataatgagtaaacatatatccacgtaaaaacattctatttattacattctatttatttctaaaggatatcaacaagaaaaaaattgataaataaatgcagctaatttaatacaccatgatatttttaggaggttgtagcctttgtgagtctagtgctgagctagacattaagattcaaaaaataattaaaaatgactgacctgaaagaattcttagtccagcaagaaccaaagccatagagacagcaacaaacctaccagacaggtttatcaggagacaaataactatgttgaaaattctaaagaagcagcagaagtaaatttatgctattaaggggaaagctccatgacttaggagttatggaactttaatcatttatgtagctatatacaaagattatttcaggcagctctgatacctttattaaaaatacaggagtagaaaaatccatggtatctttgggcacaacaaggtgaactacttagctggaacaaagtctttccatgggggaaagtatcaattaagaatttgtgctagaacgggcagatgataattccttctataaaaatataggtgcaaatagggatataatctcaaaatggcagcatttccaagtaattactctagaaaaatgcaagaaagctgagtgatatcatacctagacctcattaaaatacagaaggacagtacaggtaatctaaaaaaaaatgtccagtgcccaaggaaaaataatttaagaatggaggaaaacatgaggccaccatgttagtgcgagatcagagaggctcttatgataacaacatgaaataatagggagtgatgctgttaggaaaggtagacttgtacatggaggcttcagacccccacccaactacgtaagaatgagctttggtccatgcctatgtcctgaatggtattgcctaggttttcttctagggattttatggtttcaggtcttacgtttaagtctttaatcacctcattatcaacagactaacgcaggaacagaaaagcaaacactgcacataagtgggagttgaacaatgagaacacatggacacagggaggggaacatcacacaccgaggccggtggtggggtggggggctgggggagggacagcattaggagaaatatctaatgtagatgacaggttgatggatgcagcaaaccaccatgcatgtgtatacctatgtaacacacctgcacgttctgcacatgtatcccagaacttaaagtataataataataataataataataataataataataataaaagaatgggctttgggctttgattcttccttactaagagatacagtctgtgctggacttgctttgtgtcatatggcacctagccaacaccactgctgtatttgtcccctgtgaggaaggggtggagatttggtcttttgtttttcagcagaagagggatgtgtgcaggccaatggccttgagtcagctactgggagaggccctctggccatggaggactgacacccactactaaagctgatcttgctctgttttttctctatgtgtgtaaagctttgttcattccagtgcttgactgaattatgttttccttgaggactccattaccaagatgcagtgagaagaggtgtttgggcctctactcctggtgataggcaatagatatcacttgcttgacagatgccaagtagaatagcttcccatgacatactcaagagtcagaaacttaatatgagaaaaaaagtgcagctttaaatcggcatgcattttaccccaaattcataattaaataaatattaatactattagtatatgtaaaaataaaaagattctatacagttactacccatgaatacaaaaagggatgaaatgattttaatatttactttttatttatcaacttatttttgagatgcctgaaagcataatttttgttgtgaaaaattgagtgatgcacggcagccattacacggtacctcactggcattccataaatatgatttgaataaacataaatgaataaatgaaggaattattgatctgaccaacaatataaaaatagagtagaaaggaaactctataaaatgacattctacataaacatttactatgatgaatcttgttaaaatttttatgagatctacacttcagttaccaagtaactatcttctatcttttcatccagagtttgttacacagctgcttccagttcctcaccacatatatgttgtgttagctatgtaggagttattggaacagacaaatgacctcttttggtaattgtgttatgtggtaatgtcaattctgagtttgccacagcaagtactaagggctaatacttttgattttttctctgccaaaaaagcattcaatatgtggctgctttccggtgagtgttcctgaaaggtatcaaatttctttaaggaaaacttaagaaagaatggcagggaagtaatatttaaatcgatttttaagtgattttttttcctgtgatcaaaattagtcaaaattagtgaaggctggaatatgggatgttctcataatgaatcatgatttcctagtcattgtttcctgtaatcgtggtttatttaaagtttttctaaaattttaaagtcctcattaaattatctcatctgcatcatcacaatttctgtatcagaatattaattgccaaaacttctaaagtctttgttcttttgcatctttaaatgctatggggagagtgtcttctctatgtctaatttatgacaatccaaataaaagttatcagatttatttccccaaattgcttgcatctgatatcttagagtacttgcactggtttcccctccacagccagaattacaaagacaaaagctttttgttagctaccttcaatcccttgtgatgttcacttgcttaataagccagatgattttttttttacttcctacctaattaacactttctctttagcatttgctcttgggaattgcagaaaatttagtagaataaaaaatttaacaaacatcagaaaaatatgattagatatactgtttttaccaccaatctatatatcaggggagtaaaaactatgtaatttttgaaaatactatgttaataaatatgagtgtttattttattcgtagtgtctataaaaatagttaatataacattttagtttaggaccatatttatcacactagatcataacttttataagtgcttatattcctcaaaagattattacagaaattaatcataacagaatatattagatgataactatttcctaatatttaaaaattccacctttcctgttcttcatctgcatgtttggtttgagattaaatttcagtattatgtagaactccacaggcaaccaaatactatgtaggatattttattttaattttctattttgtgaagatgaatccagttttcgatccacttagatatgttataagttaggttatcccacaggatttgcattatgttaagcggtacgactatgagaaaactgagacttcaaaagaattcttgcccttggcgtctcaggtttcatcacaggagccattattcatggaatatcattatttttggcttctatttaagcttatctctttgtccttgatttttaaagcaatgatttctttctacaagggccagaagtatttatctggcttttgacttacagtatctgaatcatgttctgctttagttttccagagactcccatttttagctttgattattgaagaagaaggtatgtaatattcccatataaatatggccctttaataattaacattttgatcttattggcttatttcaactaaaattttgtatagcttcaagattgcaaattagttcaggactttcagattttactgttgttcttggagagtcaatacacctataagcggatttttcaaatgaaatttaactctgaaatatgtagatcctttgtgaaaatggtttaactatttcagatatgttcttcatcagaaattgtggctttacttttactaagcaggtcaaaatgtagtattagtgttacatttgatgaaatgtaaatagaatagtctaggcaagaatgttaaatatttgcttcctggcttaaaattataaccctatttttaaaaaactagctattaagtcatattttaaaaggaacacattttctcaatgataggcaaggaatttgtgtttaaatgtaattgatgagaaagcactattagaatattagttcatatattgggcaattgtgccagggctttgaagtgcttcttggctattaactttgtgataactctttcttcactaaaaaaaaaaaaaaaaagaaaagaaaaacagactggaagtactgtcaccaggcaggctcttaagtgtccaaggcaaactattttaagttacaacaaaaagagggaaacattaataattctacaagcagtttgacttgctatatgtcataagaaaattattttctacccgacagtgccagtatttggggtagagtaaaagagaactatcttataaagtctatcttattaaaataaattattcattaatttgtgatttggaaaggaaaacaagtattcctggtttatttaaaaacaggaaaattttgatttgcgtattctataaaaatagcttacttatatttaattactatattttttatatttagtaaaatagcttactatatttagtaaaatagcttgctatatttagttgctatatgtttcaagttctcataaaaataattcaataaaataagtcattttttatgacatttatatttgacctttacatagaggcctctttgatcattacaacttggtttacctggtactaaccttttaccactatatatattcttttatgcttttcatttcacgtatactttctgagtacctagtataaaagatattatgacatgtatgtttattgctgttcagaatagcaaagacttggaaccaacccaagtgcccatcaatcatagactggatgaagaaaatgtggcacatataaatcatggaatactatgcagccataaaaaataatgaggtcatgtccttcgtggcgacatagatgaagctggaaaccatcactctcagcaaactgacacaggaacagaaaaccaaacaccgcatgttctcactcataagtgggagttgaacaatgagaacacatggacacagggaggggaacatcacacaccagggcctgttgagggttagggtgctacggggagggatagcattaggagaaatatctaatgtagatgacgggttgatgggtgcagcagaccaccatggcacgtttatacctatgtaacaaacctgcagattctgcacctgtatcccagaacttaaagtataataataataaaagatattatgacagctattggcagtggtttccaagatgaagtagacatgaaacaagtcttcaagaggcttatagaacataggtggatatgggacatacacattagcaattgtcaaagaagggagaatgagatgaatcataatatgttgaaaaaatgctctgggatttcagaagagaatactgttggaatttggtgctattctcatacttgactcagcacatattgtaaaatagcaatatatatccccttaaaaggaactacacatttgaagcattattcacttagcaaaaagtactgaagggatatgcttaactttttatggaactatttacctcatttttgattcacaccatgaattacaaccaaaaacgtacaaaatatctttagaaagtaaacaaaaaaattctataaccatttgtttccagaacaaacttctccattcctcaattcaacagttttagatagcattctagggaataaatgaaagcatcaatgaaagaattatgatcaatacatttgaccaaatgaggcataacaccttactaactagcattagggttttcaatttatataaatccatcccctctccctccctcctttttctcactctcttttctctttctcttttccctctcttcctttctttgtgtaactctccccatctctctctctctctctctctctctctctctcacatatgcccttaatgtacttataaatagaatgaaaatattcaattgcttatttttcccgtatcatagtccatacaacctttaacttattttttcactgtcccaacccagtggttttgacattttgggaagagagtcacttgaaattatttctaaaacaaacttgtaatgaacatcagaatgccaggcacatacattgatatatatatatatatgtatgtatggcgcctattaattttttttgggaaaacaaatctttgttaagagcctcagatcaagaatctgcctttcccctacagatgtaactgtaaataatcacctcccctgttatcctgtctaaggcctttggtaatcacagacgctttcttcaatgtgttattctcctaatgtacccctgtcaatatactaacagtccaggagtgtagaactatgggtaagaaaataattatttaaagggtaaaagagaaaaagtggaaaaaaagctgaatcagtataaaaaatcatttagaaagtgatatataaagtaatatattggtatttattttgtactttattaattattgttaaatgatcaattatttagtacatagtaggttataggtcacgaatatcaatatatctattccctttaaaaacactactttatatatgggcaaattaagacagggagaagttaagtaattcacccaaggctacagctaaatacttatttagctgtaaatacttatttacaaacccaggcagtcaggctccagaatccataacctcaaatactatatttacccccacatacatagtatttcatttaaaagcaagatttctgatttgggctccttgagaggctagttcacaagtataaagggcaacaaagtgtatcagactcacttgtttactacagggaaaaaagagggggaaacaatattaggaaacatagctctaattttgtctcctatggctgataaaaatctgtttctaccagagaaggcagttattctagaagtgctaagggtactaaagagtaaagaaaatatagtaatactaaccaaagaataaaacactgaaaatgtaggccaataatccaatgaaagtcaataacttagagtcaaagagaaggattaaaaaaataagttagagacagtcaggtcaattacaaactattagagaaaaatgactgtgatcagagccagaactcacatgagaaaaataaacactggtctattaccctcaatttataaatgtctcataaagtgacaggcaatgtatggaggtagaaagaattataaagagagtaaatggtgtaacagtcatccaaagaatattcagtgggcaaaaataaatacaatgtcactaaaaagacatagggaaagaaatatgtgaaaacattggtttttaagtcatagtttgaagaatttaagaactctctgatactacaagtctggtgattaatgatacagggtgtacttatgagagacaattctctatgggtctttccagtttctatacatcttttgagtaaagaaataatagcttttgttctgtcactttttcaaggatgttagtattgcaaacaactttagaagatagtgcaaaaagcaaatttgtttgctgaaaagtattataaaataatgcccccttagtgggtgaagcttagaagaatttgctagtggcctcttccaaaagctgagatttttctagtctcagtgtttctgacctgtcatacaatcccactgtgtatgcggtattcacctcaatccacctctgcattggccacgcaggacttggagaagggacaaggggccaagaatgcaaacatgatgctcatattgcccactacaccataaataataaagttctttgtctctcatttggaaatctcatgacttctgccagcatccatgaaactgtggctagataacgtgttatcttgcaaagtaaaacgtcagacccttcacagtcattgatagatttgatgacaaaagtgagatacagagacacagatatttagaagatgagaggttcaaagccctctgaaagtttatttgaagttataaagagcctctttgggataaggtagtaaatgttcttacccaagtggtaggaaagaataaggatttcctaatgtccaacctgttaataaatgttgagaggctgagcaatgagaggagggacagaaacaattttcccctgatgtgctttggttgttggttgtttactctcctccaggcaggagcagaaaagtgagctcctatgacaataaagacaagagtttcatagcccattatcacaaaaggcagtgtttgtctccactgagtcaaagggtcctgtagacagaatcaatagtatcaaacaatgaggatgtagagctttggattgaccaaaaccagaagtctggttagttgagccagtacatagcagacaacttgaaaccaaaaataaatgtggtttacatgctgatctagagccactctctctctccagcacctttgatttcctctctttttctcccctgatgtcaactgctttaaagagaaaaatgattaggagtagaaacaagatatgtccccaagagagatgaaaggtcatggtcatccaacagagcatactggagaacaagagagagaggaggaatttaagtctttataattctacagggtatgggcctccaaatcaccatcctgtctaagcccatgatgggaaggggtggaaggtacaagcctgactgaaggcactgagagctgcagggcagatactcaccaaaatgcataggaaaaacaaaaataaaaaataaagaagaagacctggatatacacagaagcacagatggtattgcccctgtggtgaaaagccaaaaagaattttaaaagtaaaagaagaaaaagaaaggaaaacaaaagcctctaagttgatccggccactcaccaccagctgttttaccttctgcccatcatcccatccaatcccaatacccctcacgctgattggctggaggaaacaagtttgcactctgaaagaaaagttgtctgagaaagaagtcagcccttgaaaagtagaggtgagagatggagaggataaaaccagatcctaaaagaaatttgtttgaatctctatatccagctacagctataagtcatcctaccctcagcaatatagatatgaaagctaaataatttcaccttcttaagcctgtttgggtcacattttgaaacactggatatacaaaaaattcctaattgatactagccacaaattcatctgataattgttaccatgacatctgccttgtttttactttattatttttttaattcctctgccttggtaggcagaataatggtcccctaaagaggcttatatccaaatccctgcgagctgcgatcatgttatattgcatggaaacaaaaattaaggctgctaatcagctaactttaaataagaaaattaacctgatgaaactaatgtaatcacaggggtcctgaaattagatgaaggagactgtgaagtctaagtgatgctatgtgacaaggactaaatctaccattgttggtagattttaagatgaatgaaagtaccacaagccaaagaatgcaggtagcctctatgagctggaaaaaggaaaacttattctcagctagagtacaaaggtacacggccagaacaaattcttgattttaacccagtgagacacgtgttggattatatcctatagaactgtatgataacgtatatgtgttgtttaggctcttcattcaggaaatttgtagaaaactaatatgcccacacaaattcagttcctgtggccatgagtctactggaatgactcatcttggccttgatgatgatactgagatgggagagagttccttgaccccttcacgggacttgagacaggtttgtggctcgcctacttggccaccgcagtgatcaaaccccttgtgggaggaggagcactcaggcaagtggatgccagggctagggcaagcacttttgtgctccaggcccacagcagcatctatgggtgtgttacagttaatgctcttttagcagttgccatctgtggatggctaagtattaaccagctcagtggagtcagggtgacagccttttacatactatcctgttggtaccaggttctaacttggcctccaggaataatcaggtcacattcaggtttgaaaggcgatgaatgcagaggattttattaagtgatgggagtggctctcagtggaaggggagctggaaaggggatggtatgggaagaaggggatcttttcctgaagcccagctgtctccagccaggctcctctccaaagtcatgccatctaaagttaagcggtgtctatctgtagtttctgacatgcagttgcttcttctctcctggacgttcagccacttcttctcttctctccttcactgccacaccactctgctcctctgtcaatggagtttggggtttttatgggtagcggatgaggggcatggcgggctggggtggttttggaaaaagcaacatttgggcaggaaaacagggataactattctcattttcgggccacaatttccaggctgcagaatggaacctttgctggggaaccatcctcttttaccccctatttccctgcctcctgtctgtatcaatactaattatggaatgacagtttctatggcagtgatttagagtttgtttgagagaagtaaatgagcttctttgcagcttttcacatgttgtcattggctctgaagtagttgattaaatctcagtccctcaagcatgctcatagacacttgtagtagttttgatatgtatctcttgttgccttgaattgctttttatcttctttaaacataactgactgggctaaagggaaccagagtccaagccattccctctaaagatgttttatacctaggattccagaaaattttcctcttatatctgaagaaaccagatgtttgcactaactggggaattgtagagtgtgtatgcgtgaattatcatacaaaagcacattcaaaattatgtgtcattatgttttaaacatataaaataatagcaagaaagagaacacaagtagctattattgtgttaaaagcattgaatttttcatactctcagtaaattgtatatttaagacagtatacttaaaaagtaataaaacattaaataatgatgcattgacttgtttacattcccagggaataactgcatataaaacagaaatccaggacagttttagactttgttaatctgtttaccaattataaaatatctaagaatcactcctgaatgttccttttgggagttgcaatattgttttgaggagatctgaatcaccttttacttgttgaagaaaaattgttcacaaagattaacatgtggatacccaaaatgtcatattaccattgtgtattttggtaaatcaatgtttatatttcacttttgttgaatttaataaatttgaatttcaaaatctaatttcaaaggaaggcaattaaatattaaaactgttatctcaaataaaaacactaataatgatgttatgataagaagaaattcatcctcattctgatggaaaaattaattgccattacaaaatgaaattaacctgaatcatctggttttgtttgtttgtttgttttccagtcagaagtgaagaaaagaaaagactcttatcttctttctttctttgattcccctggttctttcttcttctctaagcttatctgattgaccaagctgcttaataaaatactattgcaacatttaaaaatataagtacttgtataatattatgctacaagatacaaatgtagcatggaataaatgaaaataaatatttagataatatgaattcaataaataggacgtcagattttggaattctttctttactgtaataattcattacacctactgtggatcaaagactttttctgagatttttgaaattttatttactgtattacatgttaatttactaacaagcacaattgaaagcagagacaaaaataaactcacattaggaattttctagctacatataggtatatcacgaacatgtcaaaatttgaagagaaaagcaaaaatatttgtaaaggatacataattacagatttattagatcactttaaaaatcttgagtaaatattgcctttaatgtagaaaattcatacacataccattatgataaaactcaagggagtcaaagaattacatgacagtaaatgattccatatacataaataaagaaaatttacgtgtttggcctaaacaatgtcgtatatgtaaaacaaggcagctttccgggatgccaaaattgtcactctagaattgcagaggcattggggaaaactgccagtctgtgaggaagatcaagatagtcacatggagaggtcacgtggaaggacagattaccaatggaaagatagattatgattcctctcttttagttcagccatttcagtctaagtgaaagaaagtgaagaagcttcttgatgactccaatatcagctaccatctaactgccactatatgagggactccaaatgacaacaatttagtttggcccatcaatacccaaaatcattagagataataatatattattttaagccattaagttttatgacagttattatgtagaaacacataaccagaatatatatggctctaattacaagaaagacaaaatttttgaagtttctgtgtaggttaataactaaaggctgcttgcaacagattccctctgtctctgcctgtctagcccactctatcttcttcctctgcctatatatatatatatatatatatatgcatatatatatacacgtatatagatatgcatatatatgtatagatatatacgtatatagatatgcatatctctgtatatagatatgcatatatatgcatatatatacgtatatatacgtagatatgcacatctatatacatatatgcgcacatgtatctatttaaatatctatatctacacatatatctacaaacacatatttataaatagcattgttctcagactgtcaaaataaaatttggatctaaagtgaaaagcagtgtaaagtggagggtaaaatatattaacaatgacagtgaatataaatttgtttgactatcaacttgactgtgaagtttctagcaccataagtcaaataaaataaaatactgtatatttctcattattaaaataaaagaaacacactaactacacaagatatgtataatttacctagactcaaagggaaattttgttttaatggtggatattacacaggtcactaaccaacataaaaacagtctctgccactactcatgagtaatttttatatcacacccagaagtcataaaagaagataatatgaaatataaattcagaaataaaattttaaaaaactgaaaactttcttcaagccatgtatcaagtattaatttccttaatatttgaggagttattaaaaattaattttaaaatgtgatactggtctgagaaagcatttcacaaaaaaaaatgaagctactttaaatatatgaaaatatgctcatctcactattgtattggagaatgcaagttaaaataaaaaaggatgcattgtcttcaaatctctagcaaagataacatagatccaatgatataccccaaggtggaggatgtccctttcatttcactgttgatgtgaatctccatggtcatcgaagggcaattctgaaataactatccagcatgtccatctctaggactccatcctacataaatacttgcatacatttgcaagtatttctataaaaaagatggtcattaaccaattattattaatatagtattttagtctaaaaagtgatcttttattaataatactaaaagtaatatttgacaatgcaaacattgaagtggtatgtaatgcgtggcaaaatacaactatatatctaattttggagcgatttctaagatttcttcttaggtgtacaaattaacgtacaaatcagtataatttttatttcctcactggtgtaaaagagaaacatggctggctgtgtgcatgtccacatatatttttggaggaaatcgtgagaaactattaacaataacatatctgtaaaatagaatagataaattataatcggaagctgattcatttttacataaacttttttatttgattttttaaaatatcgtgccattatttttgaactaaagtaagaagaacaaaataatttccaaatggcttccaaatgacttcaacaaactaacaaatatgatccaagacctggatattttcatggctgaatttaatgcattttacaacagtggttttaaatcacattccagagagccctaggatcgctgatagttacctggtcccagtgtggaggctgaaagggaggaaacatggtcagaattatgctaaatatggcccactctcaccagcttcgatcaaaccatgtcactttttatattataattgaagtgacacaaaatattttgtttgaatggaaaattttcactgttagaaaaatttgaaaattcctaacataagcgaacacattaataacatatcccctagctgtcaactgtgctacataacaacagttggatagttctattttaaactacataattccatacagataaagagctctttctgaaatgtgacagctgtatatatgtataagtaaagtctcacacacctatacctctcttgtttgaatatattttgactatggttcagtatctaggaaaacataggcactttaagagccaaatttccaaacaggaaaaatacaaaaccaaaatgtttttcatttaattctgtaaggttgtctgggttttacaaaacggttagcagtcatttcacatcagcctgccacattgattgaagaacaaattactggaacatataacttcatagaacacaccgtggtatttttttttaatacggagagctttctattttcaagttttggcttagtttccaatgtctatgtttggatcattaaatttcctttctaattgcagctaaatatgtcttctacctcacttcacttctggctattatttaaaatgcatttggctcaaatatttgattacaaaatgaacaatctgtttgcctgtatgtgtcagacacattattgtgtcttcttccccgtcaaaatcagaaaaatagtggtctgcggaatagatgacttttactgacaattttctcttcctatgttctgtagcttgggcaggaacgtttttcagatgctcttggaaacaccgcttcacaaatatcagtctctcccgccaagccaaattcctataaattgggacttcttccccatatgtttaacattatttttaaccaggattgcctactggattcttcattggattcattctagatctataactcttaggagctgatccttctctgatggctggttgaccttcatttctgtgcttaattttcattaacattgttcactctctctgaatcctgttgacttgccactgtactttcctatccccaaggcaactgatggtttctttgttctgtgctccactgagatacaagataagacttaaacttctgtctgtctggatggaggtatttttataggatcttcaaacaaattaacagggtttttagattttgctgggttaataatgagaagaaatggtttaagtcctaaatgctattctatatgtacaattacagggattctttattagaaactgattaatattaatgaggaacttattgttaatcaaaaatccatacctccagagactatggttttactaaaaaattaaagaaatggaagataaaaaatccacatatactgtggtgcacttaatttttatggaatatcaaccagttcctagactaaattttaccaatatattggatagagcaataacatttagtttgtgggaatatattaaactttaatgtctcccccatcatttggaactgagccactggaaatttgcaagccatattgggggtttgggagaaaaattcagaaattatcagatatgagttccttctctgaatgataattgtgggaaatcacctcattgaatgaaggatgaagaccatgactaaaaataatgattgcatttctttcttataactgggttcatatatttgcatatgaacattcaaacaataacaagaagaataatgtgtagggtaaatgaactcccaatgatgaatcaacctttttcagagtcagtagctgacatttcagtttccctaagggagagtttaaaaaaagtgaatggggtgaggagagtcgaagaaatgtcagcatgctgtgtgagaagagggaagaagtgaagacctgtcaactgaggtggaaaaatagagaggacatggaatatattcagcaaagcaactctgttagacaagccagtgaacactacagtgatttttttttcattttaagagataattcagcctcaaactcaaatattgttgctaaattctaaagtatgtctctgttatagtcagtttcaccatctaaacttttccatttctaatttgcgactgtattattcctttgagacataaaatgatggttaataaatataaaatgaaaatgaaataaggcagtctcgagttaaaaatagaaatatgtggagttgttaacagaaattctacaaaatattcatatatctcatattaaactagattttccccaatgcctctgcaattctagagtgacaattttggcatcccgggaagctgccttgtttttcttatcttcataagagaaatatcaagttacctacaaaaacctcttgaacaatgaagtctaattttcagcaactctcatacatatcatcaaaccaacagttgaaacaaccctaaagtcctatctttgaagctctaggagaaatattaaataccaaaaaatgccatatcggtgaaacattttaaaaataaatatccaaaaatcacttgataatctcttgcaaaatgttgaataaattataaatcttgtttcaatagtaaaattttaaaatattaaattgttttaataagatttttaagaatatttttagatttacagaaaaattaggagcagattacaaagagtttccttatactgcatgtgagatgttattacaggcacaactcagagatattgcgggtttagttccagaccactgcaacaaagctaatattgcaattaagcaagtcacatgagtttttttttctttttttggtcttccaagacatataaaatttatggttgcattatactgtagtctattaattatataatagcgttatgtctaaaaaacaaggtatacaccttaattaaaaaatacatctttgcaaaaaagtgtgaatgatcatctgagtcctcagtgaatcctaatcttttttgcttgtgaagggttttggcttgatgatgatggctgttgactggtggctgctgaacgctggggtggctatgacaattcattaggtaaatcaataatgaagtttgccacattaattgagtattcctttcacaaaagatttctctgtagcatataatgacgtttgatagcatttttccaacagttgaacttctttcaaaattggagtcaagtcttcttagtgttgatattttgagttccttccatgaatcatgactatacttgatagcatctagagtggcaaataacgttttcaatttactttacccagatctgtcagagggatcagtttctactgcagctacagcattataaaatgcatttctaaaataatgagacttaaagtaaaaattactccttaatttatgggctaaagaatggatgctgtgtgaacacacataaaaacaacattaatctctttgtacatctccatcagagctcttgggtgaccaggtgcattgtcaatgagcagtagtaatatttcaaaagtcggtctcaacccttaagcttaaaacattcagtgaatcattgtgaaaacagatgtacaatctttgctgtttcatttacagagcacaggtgtagcagatctaacattaagacttaaggaccctggattttcagaatggcaagtgtgcattggtttcaacttagttaccagctgcattagcccaataacaagaaagtcagcctatcctttgaagctttccagccaggcattgacttctcctctctagctatgaaagtcctagagggtatcttcctccaatacaagaccgttttgtctacaccgaagatctgtttagtgtagccacacttatcaactatcttagctagatcatctggataactggctgtagcttctacatcaggacttgtgacttcaccttgaatttttatgttacagagacagcttttttttttttttaacctcatgaaccaaccttctccagcttccaacacatcttctgcacatctctctctggcttcatagaattgatgagttagggacttgttctgtattaggctttggtttaagtcaatgttggattggtttgatcttctgttcggatgactaaaattttctccatctcagaaataaagctctgttttgctttcttgtttttcttgcattcactaaagtagcaatttgcttcttttttggggggtggggggatggagtcttgccctgtcgcccaggatggattggaatggagcaatcttggctcactgcaacctccgcctcccagattcaagtgattctcttgcctcagcctcctgagtagtggggattacaggcatgcaccaccacacccgcctaattttttgtatatttagtagagacaaggtttcaacatgttggccaggctggtctcaaactcctgaccttgtgatctaccctcctcagcctcccaaagtgctgggattacaagcatgagtcaccacgccctgccagaagtagcatttttaatattcttcaataatttttcctcaacattcacaacccggctaactgtttggcctaagaggcctagctttcagcctatcttggctttctacatgtcgttctccttaaccatttttagcttttgatttaaagtaacagacatgcaactcttcctttcattgcaactcttagaggccattgtagggttattaactggtttagtttcattatagttgtgaatcagctgatagagggaattaagagacctcgggaaagagtcttggtgcaatcagaacacacatttatttattacgttcagtcttacatggcatgttttgtggtgccccaacacaaatgaaatagtaacattaaagatcactgaacacagatcaccaaaatgaatataataatgcaaaagtttgaaatactgcaagaattactaaaatgtggcagaaacatagagtgagcacattctcttggaaaaatggtggtgatagacttgctaaaagtgaggttggcacagaccttcaatttgtaaaagaaatgcaatagttgcaaagtgcaataaaacaaagtatgcttgtattaacattttatgttattatggtgcatttgtcacaattatttttaactaaagttcatctttcacacaaatttccttagtttatacctaaggaaaactaaggtatagttttttgttccagcatccaatccaggattccacagtatagttggtcctcatgtctccttaggatcctgtttgagcctttgcaatcaaatgtggaggaaatacattttgatttatgtccatcaaaataaaatgatcaaagaaatattgctatttaatttacatatgagcagatagtcaggccaagcattaatatatttcaccataggtaaataaatatttttggttgctgatataaaatatattgtatttaaaagttggttaaataaacaaaatttatttaaaacattttttagactgtttcatagtaaaatttgtagaaggcatttgcaaattaatataaataaataacagaaactgaaacaaaaactatttagccctcttacaagtcagacatactctagtgcttttaatgtattagctcatttagtcctctcaacaattaaaattatttttcttatttttgagaaatccatagcatgcagcaagtatcaatctaagaactaaagtgtatgtgtgtgtgtgtgtgtgtgtgtgtgtgtgtgtgtgtatttttgtttttactgaattttaactttttgttttaatgaaagtccaagggcttatgagttcagagatcatcttgaatactgttcttagcatgatcatcatgttagaataacttggggctttaaatataacaccaatatagagccttagtcagactgatggtcctcaaatttaggtataaatcaaaattatgagaaagattaagatcactgattgctaggtcccaccctcaggggttctgattcggtagatctggaggggatcccaataattcatatttcaaacaaatgccctggtaataacattagtctagacaccacactgtaggaactactgactcagaatactaaagcagaatctctagaactggtggaactaaagcctaagcaaaatttgttgttatttgttatttttgttttatgaaattttgcaaccatacaaaactaaggggagaatgaacccccatgtaacaactgtaaactgagagaccaaaacagatgctctttcatcaactaagacagaccctaaggttaaggaaacaaaagttacctatgggtcaacgtttcagggcccatctggcatggcacaatgaagaattttctgaattccttaaactacaagaaaacccacacttttgctgaactctctaacaataggggctatcagtcaaattatcagattcctcctaaatctgacttacaacccagatcacaactctgattggaccaatgactggccttacatgcattctttttggataagcaactatagaccttaaaccaggttcagcaactcatagaagctgtgcacaaatgtctttttgtcctatagttcacattttaaagtaagagccaaatgccacctcattttaatgtcaaaatcccacccaaaagtgaacatgggatacatgttacatatatgttttcccatttcacatgtgcttgcctccccttacaaatatatataactttttttttctccaaatatgcagaatatttgtgaccccattgtgtcatagggaccctgtgaggcataaaacccaaccagccccttccctctttgaagagagagcatcttcagtccatgccagagactatgtcttccaggtttgttagcgcatatcaccaacaaagccctcttttctactatatagccatgttgacttctttggacaatagaatcaaccagcttctacaactataacactatttttttttatgttactactattctttctttcccactttggtctcactttcttttcttccctcttcttttcccttcatatttgtttcttgatgctcttttttattttatttatttatttttatttctgaagtctatttgaaagcaaatcccagatgtgatttcccttatacaaaatttatatgaatttctaagtgagaaggctttaaagcaataagaacaaaacaaaagcaaaaacaaaaacaaactaccacaccctggttaattacaagatagaattaaagcgcaccctgccccagatctcaatatacagccaggattgaaagcctccaattctagtcctaccttcctattttacatgaaagagacttgcttgaagccattgagaatattggctggaggactaaaattagatgtttatctcctaattcctcaacttgtaaaacatcttccagtagaaaattaaaaaaaaaaaaactttaaagagaaagaaagttaagtgtaatataattaaagaagtaatggtaagcagagtgctaattgtcttgtctttggattgtgtttggatatattataaaaatcaacaaacatcaacaattttgtctctatacatgtgctcatttatcagtatcttctggtgtgctggaaatttgatttagttagaacacctggctttaggttcgcactcaaccatatacttgcttcctgcaccaaattctaaaacaaatcacttccttaagtttcagtttcttaacttgggcaacgtgaattgtaataatatttaactatgaaaataaatgttaaagatctttataaaataacaatcacaattaaaaagcagacaaattgaaaaaaatgattatcaaagggattgcttcagtttccttatttggtcatgactttgttttagggactactgatgactacagacatttctatttaactgcgtgtgtgtgtgtgtgtgtgtgtgtgtgtgagagagagagagagagagagagagagagagagagaaagagactacgtacgttttaatgtgtagttttctatgggttctaactttaatgcgttataaacctgttttcagtcttaattgttttgtctggctttaaaattcccagctactgatagttaaatctgatattcagactattatgcaattttctaatattttgatttcctcctttatagatcattacatgtgaaacagaccattgcttcctagtttactgaaatgtgctgaaatacattgaaaataaattttaaaggtcacaataagtccccttaagaagataaatggaatacattaacattttttatcttaattttcttaaacttgccagacatgggtatttgtaattttttaagcctatagaattttctctagcctatagagttttctctagcctgtacaatttagaataggagcaacttcaagcaggtaagcaagtttggaaattttttagtttaaaattagcctatgaagcccagcttctttgtattattttacattgttaaataaaagcactagtgaatctgcatcaacacataataaaagaaaactaccctctctgggttttatttacatgtataaacaaaatttagtctcactatcctcctatatcacaaaaaaaaccaaacataaaatataaaacaaacttattatacaatgcatcccagcatataaaagataattaaaatttagagaaatgtttatattcaatctaaattctacccaaaaaatgtcatatgctttccacaactaatcacacaaatgctatataagctagcatagtaatacaattttacaaaaaaatatattttagcattttctggattcgttagataaaaaatagaataaaattctaaggaaatatgtatcaatgtctttggtacttagcataattgatttattgctttctgaaaagctgttttctttctcaggtgaaatatatctttgcatcagtggaattaaaggcagtattgaggtttttccctatcatttattccagcactttagaaacatcactctgttgcctgtttaaccctgtagagaaaagattgcaccatatgtcattctaggaaaacaaaacaaagaacagcctttgcatcttaaaagtatattatctatataaactatgtttcatgctagcctgtcaatattcacaccatccagaatatatctggttagatttttatcaaagttcaaaactttatagtgatagtttgtccttaaaatacagcttaagtggtgtcttcaagatttacatcaaggtgacatccgataggctgtcatcctcagagtcgctaaaattgaggtctaatcgagaccggtaggattgccaatagaaaagccaagcaagaaatattagaatgatgcaggcaaacaaagaaaactttgatttcaaatgtgagctgcttttcaaaaccacagggtcatacactctgatttgcaggtgcagattccagaagcagatactttgtacatggtcagctttgcacccaggatgagaattgtcaaagatttatttacccaaaggtggtaagtcaaaatggagtatagcaaaaacgttcctaaaggccacaaaatgccttttatgatcctttctgaacagtgacacatggaatttcgcccaatgcagtattagagaaaggttggggtaagtaatttcctcctaaaggggaaaaaagcctacaatttttgtataagtaactgaatccatatagaggcaggctggcactgaaaaaggtcacacagtgtgagtatccttagaaatagaatgtttcagtattgtggggacaaagttcagctcacttaagaacatttcctattacgaaccagttattttcaaaatgagactgctatgtagttatataaattactcaacaactgcagtagaactagatgtaatagctacaataatatttctagtataaattatctaagaatcatttttaacatatctccttggttagtattcattatactcaaagcttgagggacaattgaataatcagcctctatattttcaaagttgttctacattgagagttgtcatcatttagttaagaaaactcgaaatttttgcacttatgttcaatgaggcaggttgaaaaagagtttccgctcttaacacgtcattattctcttttttcaaatgtaattacttagtcaattaacgtcactcttctgtaaaacatttaggtgtaagtgaaagccatttctttatcatcatactgttttgtctgttacttttgtaatctacctccttttcatagcaaattctttaaggggataaactaaaaggactattttattttactcttcatttgtgtttctgtgtttcattttcctgtctcctgtatattgccttttatttttttgatggagtcttgctctgtcgcccaggctggagtgcagtggcgtgatctcggctcactgcaacctctctcgtctcccgggttcaagcaattctcctgcctcagcctcctgagtagctgggataacaggcgtgtgccaccacgcctggctaatttttgtatttctagtatagatgggggtttcaccatgttgttcaggctggtctcgaacgaactcctgacctcatgatccgcccgcctcggcctctcaaagtgttgggattacaggcatgagccaccacgcctggcctgtatactgccttttacatttgaggaggtctagtgactgacgtgaggatgaatgctaatgaggtaactaatgtctccaaaggatttatgggaaggactaattttattgcactttctaatgctcccatttgtaaaaccaacattatttttgtttgttgacatgtgatgtagtaattctatatgatatagtaaatatactgtgtcatagtcctcttatttatgccctaacacaagttatctccttttcattattttggatgtcaataatttcatctgttttaccaaaaaaaaaaaaatcccttagtgtttcccttctttgttgtaacacttgaaaaatgagtgactagctcagcagggaaaccctttagcctcctgaatgaacatgagaggcaagaaagtgagtagaagtgagaaagacttaaagtattcaatttcatcatttctctagagaaagcccctacagatgtggggttaggccaacaaagaagcactttggtatttttctgatcctgatcagttacccatgataaatggaatatgaaaagtattaagttctatgaggatgaggcattttcatatcctgttgctagttgcaaggtttcttttttgaatagtctttcctcttttctctcttgtcccacaccccaacctatttgaagcaataaaacataatgatgctaaacaaataaattcataattgtgtaaatataatttaccaaatcaaaagatatagacccagtcataacaggacctatttctctttctagttttatttccctttcattgcactactcaccatctggcatattatatgcttggctcacttaattgtttactatttgtctcacacactaaactataccctcgccaagtattggggttttttaatgtctttttattgccatatctcacagctggagacagtagcagagacatagtaggtactcagtaaatatttgctcaaataataaaataatagataaactaatcagaaaaaatatgcactcttatgggataagaaaaagagaaagaacgctcacattctctaaaatgacacatacatatatgaatgaaaaaatgttgtgtagaataactattatattcaagcataatttaatgaacaagttatctatatggcgcaattactcatcttgtgaaaaacaggctactgaaaaaatgattttaattttaatttttaatgtatatgtacaaaattcatttggtattcaaaaaggcttggtttgttcaaaaatatcattctatatgtagtagaaaaagtgtaaaacaaatgttaaatatgctttattaacagatttatgtctttacttaatagtaaattcttgggattttaactgtcagcaaatacaaagaagaagaaacaaatttgaaataatctcacacaacatttaaaatatttattttaattttagcattggaaaatattctgccactggaaacactacaatttatgctatgagaactataaaagctcagaagaccaaatctttaaataaaaaataaaatgtgtgcgaatattttccatccagcaaattgaaacattttattttaaaattaacaaaaacaccaacagttttttgaagaccaggaaataatgacgactaggcactaagcactctccacatgacaaattctgcttcaatccctagaaggtgtgagaatcagagcagcaggagtttttgaacccactgacaataataaatcttagattactcacttcacaatgcatacttgatttagtggaatcaagaaaatggattgaggctgtctgaagaaggtctgatatatgagagggggtctcttgtgctgttcaagggcaaaagcaaaatcataaaattgattcttcatcatatcggtgggagtaaaaggcttaaagtaaaatcctttagttccagtctatttttcttatgagaaaaattcagtttggttttatgtaatataaaaatataattccacaatatagcttaaaataacctatacaaacacattcaaaacaaagccccacatattattattttggcattttgagtttctgatccttccttaatatcattcttccaacttttcaacatgagatcttcaaaattagtgatggaaactcccaggtggttattcaatattgtttgggtataatttattaacaatctatgtgttcaatctttaaaacttcagcaaatatttctgattttcttgttacatgcacacctcatcctgttttcagacacatagtatgaccccaaacctggtcatcttggggttggataagggtatgtgattaattctggccacttgcaggctatagctcttatttgttggaatggagtcctcctacagcttgctttgctctggcatgatgaatgtaaactattgtgatgttggctgagtgactacacagaccaggaatttccccttcaagtctctgccaccaaaatgtgatggacaagttataggagtgaaaaataaaacttactttaagccactaaaggtcatgtgattgtttatcacaccacgtaacctagcatgcattctaacagagtgtttcctaacatattcactacatttagaataaaacgaaaacagagttgatccatgttatttatggcttctgtatttgtgaattcacctactcactaaaatttgtttgtaactccagaaacaatattctccgtgctcccatggttattcctgaacaagtgcaaagcaactaacaaagacacttgatatgcacattcccagctgaagtcaaacaaggccctcatactgtaaacaagtgtccttttacagtctatttagtacccttttttaattctgcattttttagctttttgttagaaactttgcagaagcctgtctttcatttagtctttcatactttgagtttcctaacttgccctcattccaacatctctgcccagatgaatcctaaactaattcagtgggaccacaaccatgtgcactatgatttcttcactctaaaatccagatattgggaaactgggatttgttcatatgtgtacgtagtgggtggcgtgggagataagatggagttctgtctcctccttttggtaaaaatataatcctactgaagcactaaaaatcaagcccattttatacagcttggttaggttctagaattaatgtttattatagattaagtagacattttatgggttgtcctgggaacacaaccatcatttttaatattgtttctatggtaaaatgcattccaagttccaaacaattgattcacaaactagcttcgggaacactaccagcttctaaaatgtggattcctgtatagcaaatgagtaaagcatagaaacaaagagataatacccaggttttctatctttagtgtgccaggatggtagcttagtaatgataagactatctgcctgggcagcctggtaaacctatatttactcagcacttacttatgagattaattttttttgtcaattctgctacataattcgtagtcatatgggaggaatttggccatagaaatgataaagaagaaaatgacagaatatatagtgttgtgatcctgtccacagtacatcactgtatttgtaatgcaaaggtctgtgccctgacaattatcttcagcttattactgtagcagagaatagattgggatcactaacggacatgacttaccacttctttactggaccaatttgccttactgtgtgtgtgtgtgtgtgtgtgtgtgtgtgtgtgtgtgtgtgtagtgagtagccactaggttgaacaaatctgcccaatcaggctgtgttaaatagataatgctgattaggggaagggaagaagaccagaagtgagattagaattattatcagaagtttacatttaatatgcattatacatttagacaaaacatattgatatttggccatcaatcttgcttgtatgagctgtctaggaatgatggaaattaagagctacagttctcattaaaacgtttaattttaaacaaggcaatatccacatatttacagaatggatgctaccctgaaaaataattgaatctattagagattgtaaagaaaagccaggagtccactgtccactgaacatgttaattgaatccaactttgcaaaaagatgaagcaaagaatgttctctctaattgcaaaggtccccagctgggtacatatttctgtttatcacttcacacctgagtgacccatggtgtttcatacagatcctgtttcttaggaaaagattcttaatttgcaaaataagcccattttgttagtcaatgacttacacagtgctttggcatgaaccattgggaagaaacttctgatttattcaatgagatttgtttatttatacctaataattacatatatttatggggtacatatattttgatacatgcatacaatgtgtaatgatcaagtcagagtatttacaatattcatcacttcaaacatttatcatttattcatattaagattatttcaaatcctcttttctagctattttgaaacatacaatatgttgttttcaactgtagtcaccatattgtgcaatggaacactagaacttattctttctgtctaacttgtctgtttgtacccactaaccaacctttcctctctctccagcctctaataaccattatgctactctctactccacaagtgagaatatacaatttttgtctttctgtgcctggcttatttaactaaatataattatctccacttccattgatgttgttacaaatgacaggatttcattaatttttatgtctgaataaaatttcatcatgtatataaaccatatattgtttttccatttatctattcatggacacttaggttgatccctgatactggctactatcaataatgctgtaaaaaatatgggggtgcaggtgtccctttgatataaagatttcctttcttttggataaatacccagtagtgtgattgctgaatcatatggtagttctatttttagatttgggaaaaacaaccatactgttttccattatggtagtactgattcacattcccctcaacagtatatgagagtttttctccacatccttgccagcgtttgttattttttgtctttttgataattgtcactctaactggggtaggagatgatatctcattgtggttttgatttgcatttctcagataattagtgatgttgactgttaacggattgaatgtcttcttttgaagtgatgttgactgttggacatttgaatgccttcttttgaagaatacctattcagattctttgcctagttttttatgggaatatttgtgggcttttttatttttatatttttatttttttgctggtgagttgtttgagtcccttatatattccaggtgtcagtaccttgtcaaatgaagagtttgtaaatattttctcccatgttacatgtggtctcttcactctgctgattgtttctgtgactatgcagaagctttttagtttaatatagtaccatttgccttttttttctttttattacctgtttatttgaagtcttggccataaaatctttgcacacaccaatctcttacatcatcccctcatgattttttctagaattttatagttttgagtatatttaatttttaatctatttgagttgattttttatatggtgagagataggggtctagcttccttctttgtgcccattgagactcagttttcactgcaccatttattaaagagggtgttctttccgcaatatatgttctcagcacctttgtttaggttctctattggtctaggtgtctgtttttatagcaataccttgctgtttttggttacaatagctttgtagtgtatttcaatgtcagatagtatgatgccccatttctgttctttttgctcagtattgctttgtctgtttgacgttcaagatgatttttttaaatttacaggctataaacgacattaacaaaccagttttagaaccagtgaccagtattcaagtactttctgaggttaaaccccagatagaagaagttaatcacttttatgttgacaacaatcacttttttcaggttgtgtctgaaaacagaagtttaaatggatacagtctaactatggaaagttaaagttgctggatggttgtgtcacactgtaatctgtggatgctaataaaaaagagcaattactgagatgtaaatatagacaaaatatgtttaaatgtatagttagattaataagaataccccccacattttcctcttgggatattggaatatctaggaagagctatcctagtcccaattctctgggaagtgcagaatctagacaagaacataccagtaagcctatagcagacgccaacattattaaccaaaccagcatagcaacccatgatggtaaagaacaacgttgcacaccagcaaagtgaccacagatattatgattgatgagacacagatgctctgttaattccatgatggaaaacgctattatcctgtgacagcgcttaggattttgcaatggcactttttctgagcgtcactagcataattttacttattataatctgatgagtataagatatgttattaccaaacgttctttttttcttacagttttatatataaaatgcagtgatcagactataagtggggagtcatggctctcatataatatgaatatatgggttagaactcgagcccaaaaagtataatacacctcaaagaagatagctggggatattgtgtatatcctatttctaatggcaaatatctggcgaatgtcataattatgtctttagtgggaatgagtaaaggactaatatgtttaacatttgaatgtataaaaatatagatgcttaatttgtgtattttaatacaagaagaattttatataaataatatctataataaaaaatactatcagacatacctaaacctaaataaaagcctaaagaagtctacatatttatatttaatcagcatgctgatacaactagttatctaagtgaaccaaatatcatcaaatatatctgaagtcatatgaggtcatttatgaactacaagtcttcttccacctaattagcttacagttgacctttagaaagtggtacttaattgaacagaaatgttcagaaatatgttctgaacttgaacttagcacacatgaataaacaaccaatgaaaaagattatattgccacactattttggaatcagggcataaaatataagtcataaagatagaaaaatgatgttttggaagtacctaccaaatatgtggatgaattatgtattttctatagagcgatatatatctcattaatgaatataaatatatctatgcacacaatacccacatgccaatttatgcatatgtgtatatgtagtgtgaggtaacagatatatatatatatatatatacaatttaatgtcatgtaattaaagataatgtgtagtattctgtcataatataaaggagtaatctttatctatgaaagacttctttggctttaaatacctgtcttttaacatcactcatatgtgtcatcttttcagcctttgccttttctaacttaaatcatttatctatttacttcaaatttaaatggaagttgcctctgtataattttttgtagtgttctaagctcattaacatatagtgagtatctttggaattaacatgcaactaattacaaaaggtgttttaacataatttgtatttctataattagaatgatatgcacttcaaagaaaagatgtaacttcagaatttataaagtataactaaatatataagaaactttatttatataacagatatttattgtacatctaccataaaagtattttccacactactcgaaaacctctgcagacagaacatactgagaattccatgccattatggagctcctaattctagtagtggtacacagacaatacaaacagacataataagcaagaaagttatttttaatgttagaagcttacaaatgttatgcaaaaaaaaaaggatccaggtaagtttaatagggtgttctagtagtagaagtggaaatatttgattttaaatcaagtaatcagagtcagtgtcgatgagaaaattgtatttgagcaaagatttgaaggaagtgatgatagatttttagtcatgtggctatctagttggcagcatgttcccatctaaaaaaaaaaaggcataaagcagcagagtacccaaatatgttcatgtaatggaaaagaggctagagttcctgcaggagaatagcaggggatgaggtcagtaaaataacaggggtaaaaaagcatacgatcctgtatgcatgagaggactgtagcttttaccaagagtgaaaaggggacagataacttatttttgaagagacaactaaagtgaacacccacttgtataaaaggttattctgcctggtgtgttgagtagaggagaaccagggaaaccaattaaaaactcactgaaatatttcaagtgacaaaggagcatcatttgtaccttactggctttgcagtgaaaatgataaatttggccagattttaaaaatattttgagagatttcataatgggctagttacatatgagagacaaaaagaggagttaaagatgatgccagggtactgggactgagcatgtaacagcatgaagtagtcatcagatgaggtggagacaatagcagatgtaccagctttgttggtatcactgagggtgctaccagggcaatgttaaatttgaggcactttttaggtatccacatagagatcaggagtaggcagctggatgttcaagtgtggagttcaggagagaggtctgagctggacataggtattttggagtcactgacctatgaatggtatttaaagccttgaaatgcatgagactgacaggagagtgaggtgtgttcaataactgagaaatacctaggacacgatcctatgatacttcaacattaaaaagtggtataaaacaagagactccagtaaaacagacagagtgacaagttaattaggataaaaacataatgccaagtaaagaaagtaattctttttttaaaaaaggagatagtgatacacgatgccaaatgtttattataggttaacaagctgagagcttaaaatgaccattgaatttgtcaaagtgcagatcatctatggccttgacatgatgaacttcagtgaactggtagcaatgaaagcctgattggagacgtgtaggagagaaagagtgttgaggaactgaagatacatggatggttttgtagaaaatgtgaacagagatatgtgaaggcaaccgacgtgccaagattggtcgagggaatacctccttttttaacttagaaaaaataactgtatattcgtacatcttggatgatctcacatcagaaaaataattgatgatgtacaagaaaaagagtagggaatgtctggagcaatgtccttttggtagtgacagggataaaaactagagttcaaatgggtaaatactgcctgatgtcctttacatagagagatggagaagtattatagactcttctcttttccacatgaaaaacagccttcacaagatgagaattgcttgaaaaactatcgtctaacttctttcatctatcaagcttcctgtctatcattcttaaacctctctaagtctctatcaacaaagattaatgtgaatcttaggggagattttctccagcagggaaaagatctgatgcatcaagcagttatgaggatttacaggcagacttctggccagtgagcctcactagtcaacctccaaagtgcatgcatatatgcacatgcacacaaacacatgcacaaacacacacaagcatgtgtactgattacttataagacgcatttcttagaaaggagaaggcaacaattcctaaatttctggaaaagtataaaatctgaaaatggatgcatgaagaaataaagaatctgaatagtctcttatcttaagctaagacttcaacaaggccttttgaccaaaggctatcatctctaagtctcaaggacaagtaattagcagcaattcatacaggatgtaggtggaggagaacatgtaagctgcaaaaagggatcaaaggagatctcacagaggcaccaaaaatgtgctctccaacactaaccataaagataccaagatggtaaccaataacttgccatcacagaacccaatgattttacagttaagttctaccaaatgttcaacttttgctgcagaaaacagaaagagatagaaaaccactaactcatgttatgactaaaataaaataaccttgattcttttttctttttttttttttgagatggaatctcacttgtcactgaggctggagtgcagtggtgcgatctcggctcactgcaacctctgtctcccgggttcaagcgattcttctgcctcagcttgccgagtagctgagactacaggcacctgccaccacgccctactattttttgtattgttagtagagacggggattcaccatattgtccaggctggtcttgaactcctgaccacgtgatcctcctgccttggcatcccaaagtgttggaattacaggcatgaggcacctggccctgtcataaccttgattctaaatttggtaaagaacaatatgagacaaaggaaaacacaggctcaatttgctcaagaacataaatttgagaagcccaaatcaaatactaactatattcaaaatcacattaaaatattgaagtaagatttatgccagaaatttaaaaatggtatacaatatgtacatatgctctaagaatggacacatatgctactctacccccagctatcacaaatgcagagtgattaacatactggaaatcaccatttttaagtagtttcgtctagtctcattccctcttacaactctatgatcagacttccttgctatcacttcactaaagctcatcttatctaagtcatggatgatctgcactatgacaaacccgatggacaattttaagctctctgcttgttaatctataagaaatatttggcatggtgtatcaccatctccttttaaaagttttttttctttacttggcattatgtttttatcctaattcacttgacactctgtcttttttactggaatctcttgatttgtaccacttgttaatgttgaagtatctcaggattctgtcctaggtgcttctcagtaattgaacacatctcactgtaggtgtgttcaatagatcagtgactccaaaatgcctaagttcagctaagacctctctcctgaatttcacacttgaacatcaactgcccactcacatctctatgtgtatacataaaaagtgcctcagatttcacattgccccggtagcacccctagtgaacccaccaaacctgcttcatctgctactgtctccacctcatctgatgactactccattcttttacatgctcagccccagcaccctggcatcatctttgactcctgtttttgtctctcatgttactgtccaatcatgaaatcactcaaaacatatgcagaatctggcctatttttatgattttcactgaaaagccagtaaggtacaaatgatgtttctttgtaacttgaaatacttcagtgggcttttttgtttgtttgtttccctgattctcctctattcaacacgccagccaaaattacctttcatgcaagtgggtgctcatatggtagatcaccataccgttcagtggttagaaacaacaaaatagatatgcattcagcaccataagtagatggttaaaatatagtgctgaaaaaatagaaaagaaaaatctatagcaaatagcagttacagaaagtaaaaacatacacagctctgtgtatttagcaaagttatgtaaatatgtgcacatccagggacatatattaagacattaaagtactaatttgcccttgagaaagcaaagaatgaacatggggactggaaaggaggaacatattaaatacgcgtacctaataaaaaagagaaatttgtgcttacaggccaatcatgataggaactaagaactgaaggctataattaactcaactctctgaatgtgggttttaaacaaaaactgaaatgatatttcctacctcttagggttatttgaagataattttagaaaatgtgtttaaagggcttagcacagcttggtatatagtgagtattaaataagggataactattatgcttttgttattattattgttattattatagctgatttttttaactctccctattaggtacttacataaatgtttgttttgctccaaaaattacatatcacataaagccattaatataagctgtaactcacttttagaaatataatgtgaattttcttgatcatatttgaacactgtattggctttcctaggactgagaaggaggccagctggaataggttcacttttaagtgaaataacatgagtgaatcttcattaattttttttcctaagtcttcagacaggtttagaagctggaagttaagagataccacataatctgatatcatactggatttcactctggagttcctgagactggggaatgagacgaagaataaatagctttgtaaattctatccgtaatcaaagctgatttgctgcaggataatttttagaaaagcaaaacctggagtcttacccccgtcagtcaaaaataatatgataaagcaattctctctgatgggatccatgctggaagaaatcccagataatacaatgaaacatttcccggagcagagagcttggttcattgtgccaaacaatggctggatcagtggctattattggaaagcaggcctgccagctttgctttctggaggctgtctgctgagaaaacaactgctgctcagtaattaactcctcccaaatgtcagacaaggaagcagcaacagtgacctcttgtgccactcccagtcccatttccccatgttcaagccggtgtttgcgttttctagggctattactagacatgtacgcattattgctgctggtctcacaggcccttcaagtaggcaccctcccagtgttcagttattactttgaatgtgcctttactgaaaaaaaatccaagcactgaatagagtgaatacttactattttataagcaattttaataaaattgggagtaatgaaggtggaattgaagaaaggaagaaaataagattaaagaaatgatgaagaaaaacaggatttcatgtccttagtgtagcaattttaggtggttaatcataccggatttgaatttagaaacactagtggaatctttcctttcctccttccttgtataattaagttaaagtctctacatcttagtttattcagctgtaaaactgtgcccagtgctgctagaataattaaatcaaagaaaatgacattatctttttagactgattatcataatacccagcacaaaacagattcaataaataatttatatttactataattgtgaactaaaattaacaaatattattaccaattatatgtaatataccatgtttcttttagtaataaatagcaaaacaacaagaaaaattattcctactattactactacttgggtaataattagggtatactctctccaaggcatagttaacacttctgcccctaaactactatttgccttatcaagtatttttttcccagtggctatgaaaatgcattaagatgtcattcatatagtattttctttaaattctgcaacctaatttttggtcagtttacactagttttcaatatattctactacatccttagaggtaaattgactacgaaacagattttcttcaattatccactgtgtaagtcagatgtaactgatggcttagtcaaagagaaagcagtaaattgtcattgattaattctgtaaataagtgatgaatctattatgtcttaggcataatttgtgtctccttcacagataatcctgcagttaggtaaactatagaggctgcaaaattaataattacagaaaaacaagataaattaagatagacatataaatgatagatagatgcaaggatattatatatagataggtagataaactgtgaaatcccagtgggaatgattggctatttagaaatatagaaaacattttacaatctgcgatgtttgagactggaggggctggaaatgtttacaaagaagaagaaagagaatgatgatcagaggggcaaatgtgaaaacatcagagcagcataaaagaatcaaacggatgagggctttatgaaattcttggactgagcttcttagtttgcaagttccatcacacatcaagtaactattaagctgtatctgggtctctcactgaatggaggggatttgagatgcagttgactagttggcatacaattaataattttttagaaatttagataaatgttgactttgatttttcctttttaaaaaaacctctgtggccaatattctcttgacatctcccatgtttttgtaggtctaggtaagttaacaggccttagaaactgtacctagaatgcttgatagacaaaagcatgcctgcatatgtgcaatagagtagagtggggagtgtggctaggtagtgaacataaaagaagtaccctgagagaaatcttaaaaggaagactggtttcaaattatgaatggcacaataaagtattttttaaaagaaaagcaaagtattagggagatcaaattatataaagaatggctaaagtataaggtagagggattaataaaatggaaaaaacattggaatacaaaagaacacttgagaggttaacacaaaactctaaaaatattttatgatttttgcactatttcaatagctatgaagacaaaaatattagagaaccagaataatacgagatgttcctgaaattttcagtattgtttgagaaaatttcagccatatttactttgggagtacacgttgctgcatacatctctctaagtttcattcctgacaaaagattaattcaacaataatcacacacacacacacacacacacacacacacacacacacacggcaaattgaactgcaactgtgtctgtataattgaaagaataaacaaaaccactagttaccctgaagctgcaggagattcatacattattataaatgatgaccgtcatctaacatatgcatcattaatgaataaactaaatcttatgaaaaactagtttagtttgtaaaacacatatagggtatatgttaataccactatttatataattcttacccagcagaagattaaaaatatttattaagaatataaatgccttctaccaattattataaatctgataggaattaaaattaatttacatttattcatttattcacatatttgttgagcacttattgtttgttccacattttcaaatcctggcaataaaaaaaaagggataaagattcctcttttcatggactttatgctgtagaaataaaatatttagcatattttaaatattttaaataaaatgtttagcatattttaaaggactatataagtgaattttattaggatgcttctatgttccaagtgtagacttttctaaaaggtctatgatagacaacttttacatttaaagggaatagacgaagtctgctctaaaatagaaggggacttatactagtaaaaattctatatatttggatttatatatctatctatgtatttttttcaactttaaacaaaagagactcagttattcaaataaacgatacattttacagtatttccttttgtttctcacaaaaatgctatagtaaattttggatattaaatgatatacaaagcatttttcaggttaaaatgtgtctttataagcaagtgttggattgcatcttaacacactttttaatctcagaaatctcttcaatttctgaatacaagttagctcggaaatattttttttaggttagagaaaactgaataaaataaaaatcacatattgaatgaagagtggtcaagtttctatcccactttgaagttagctcattagctcatatatatatgcagtcaaaaataaccatgtctttgtgtgtgcatttgttcaagacatgtaataggaaatattgcacagatataagagtaagataatattataacagtttattagaaaaaatgtatttcagcatatttttatccctaataatatattttaaaataggaaaaagttttttaaaatcctaaataatgaacaatggcttcacagtatttaattttaaaatcataaaatttttttcttaacaatgttatcttgcctcattaaaagtgtgcctttgtatttaagtatgctttgtcattaagaggatagaaaataggttaaatttaaaaagccaactcagaatgacgaagaaccaaataccactatagtattaggtgtgtaggttggtatactcatacattactgctaagtagtagtagtacaacccgatgaagagtagttcttaatgttcaaaataaaaaatccacgattcatttcacccatcagttctatttctagtgccactgaaattttgaaaggaattgcattaaatttgaatattattttgaatttggatatcacattgggtaagcatagacattatagtagtattaattcttccatgaacacagaatacgtttttacttatttatgtattcttcaatttaattctcaatgctttacagttttcagtgtacaaatgtttcattccctttgttaaatgtattaataaatattttattctttttgatgctattatgagattgttttactgatttcattttagatagataattattggtgtaaagaaatgcacctgatttttatatgttaattttgtgtcctgtaactttactgaattcatatattatttctaacaaggggtgtgtgtgtgtgtgtgtgtgtgtgtgtgtgtgtctgtgtgtgtgtgttgtgtatagagtctttagggttttctacatataagattatgttatctgcaaataaggatagttttacttcttcctttctgatttagttgccttctatttatttttattgtctaattgttcttgctagtatctagcactatgttcagtagaagtgacaaaaatgggcatgcttgttttttgttttggatcttagaggaaatgctttcccattgattatgttagttgtaagatgtttataaatggcctttattaaggtgagggagtttccttttgtgcctaatttaacaagagactttattatgaaatgatgtgaaactttatcaaatgctctttggcccttattgaaatgattatgtagttttttcattctgttaatgtggtgtattacattaatttatttgtgtatgttacataaaccttgtattccagagatgaatctcttcttgttgcaatatgttctttatatttcagagtagaaatcctacagactgtctactgccttataaactatcagagcactgctaaaataatcctttttaattttttccttggtcatataataaacagaaaattgcccaatatagtctattttaggatccattggaaaaagtatttgacattccaaatactgagatttaaaactagaggagataaaaggacgttttacaattggacacctttctccatttctgattatgataatctcatttctcaaatttccacttttctaagtatgctaaacaagggtcaccaattgtatctattaactagctatagtaaatcactaattttcaagttagatcatattaagggtttggataccaggatgaaataaaatcaatgtcctcatgaagcataatgttggagctggaagttggccatgattatcttgttttcatatgtactctcaaaagtacatatttaccttgactaaaggaaatagaaatgacttgtgtttgggattttggcttaacatctcaatgggaagactgaggtacccattcataaataatctgctaatttaatgagttgactgaaaaatgttattaggacattttgaggttgttccatgaaaagtttgtcttagcaatatctataaagagccatatttttttttctcaaatttgcttttgtcgatagcaaatttcaagtttcaaaaacaggctcaacatttcacagttgggaaaacccacactgttaaaagcttttaaggcaaaaaaacaaacaaacaagcaaacaaacaaacaaacaaacaaacaaaaaacttgacatcttgactcccaaagaaagacatatataatatacaaaaaagtaacactaaaaaagtaatttcactagtttttcattataaatactaaaattaataggttttatgcaatattttctatccttgttctttcccttagtaacatcctccacaaccccaacaaaacagaacaacaagaaaatacctacattctcctggttatcggaacttaagctattatagttagcctcaattcagatgaataagcaatgataaccattgtaagtaagccttgctatccatcatattctcatggaagagaatctaatgtaaatgaaagtgttttcatttttattcaggatgactatgtaattacatatgtcatctatcacttctaggatcctcctaaaataaaattatgatagcacaaaaatgaataaattgacaacagtgaagagaagaaaatggggttcagggctaaggggtgggtatcaggggaatcatcaaacttgaggaaaaagaaaagcatatggagcaatttgaaggataaagttggcaggaaaagctaaattcagagtttaacaggagggcctcgtagaggtgggactcaagatcttttctgagggctttgctgctgggttaaagttaaccctggccacagagaattaaagggacaggtgaggctgaaagcaatcaaaagtttacttgagtttctgatatacaatttcatatatagacatctaagctagtgtctgtcacgtgatgtcactacagaacaaacaaaattcctatattttctgagatcttaatttgtgagtttaataatgccctcttggataaataaaaagaggctcagtggagaaacatgttgacacagcattgtgaaattttctaacagggactataaagacatatgaaaagcaaaagggtgtcagtaaaagactttgtatgtgtcaagcctagcactcatgctgagcttttgtatggccaatgagctaggaatattttttaattgtttaaaaaaatttaaaaaactgtatttgtgacatttggaaattgtatcatattcaaattcattctccataaatagctttattggcacatagccactctttaattttcacatattatccatcgctgtgttagcactgaaactacagcagcagagattgagatcttgtggcccccaaaataaaaattcaccaaatcatagtgcagctataaataaaactaaaatgagaaagacattataagcaaagaataaccaaaaggaagaaagaattctttgggactgaaggtaggaaaattttacctttgaagtgcttaggactcaaaagcatctaaattataaaaaaggaaaagtaatatgtaaaatataaagcacaaataattgctatctccccttttacagaggtatttgctcatgtgtattctataatacaaaatggcaaaacaaaataatgcataataaaagaaaaaatcttttattttagcagccatagtaggggatagaagacgaaatgctcttaaagtttttaggaataaaaattattcataaagctaggattctttagccagagaaatatcaaaatatagggtagaataaatacattttcaaacagacaaggactcagaaaatttatttgctgggatccatttttaaagtcttacttgaggatatattccagcaaaatgaagggaaaaaaaaaacaagtgagattggattttggaaacagaacccacccagaacacaacaagaagagaagatttaggattagagttgtacttcatgtttaaatgcatcttattgtttttaacaagaaataattttatgcttaaccagaaaaaaatgcaattagtatctcaagaaaaaaaataaaaattcacctaatcattgtgcatatataaagaaaactaaaatgagaaacaacttttaagcaaaaaatgtccagtaggaaaagataattctttgggattgaaggtaggaaaattctacctttgaagtgctttggactcaaagcatctaaatcataacaaaaggaaatgtaatcatagaacagtacatggtcaagaaataaataaagggtataacatcataataatagtcataataatgaaagtgacttttttactactcttcaacatttatagccaacctatgaacaaagaatgtcttgtttttatttttagtgcagaatgtaactgttaacaacattagaaatatgaagcttttctgaaaataaaagtgctgctgattgtgggaaattggagttggagaggaaagtcagggcactgatactctcattctctatggcatataattggaatactgccttatgtgcgtagtgggatcaaaataatgtctaaaacgtggaaaatagggacaaaattatactctaaaataggaactgcaaacaccagtgcctaaggcatatcagttagtaaaagaaaacagcgagtgtaagaaaatgtatgctggactggtgctattgcaagcagccgcccaccagatatttaactgttttttagcacatgatggagaccacacagaactcacaggcaagatgggcctctaactctggatgacattttgtaacttcatatttaaggttatgaaataatcaaaagaagaggtaaatatgacaatataagaatttaatattagaagaaaaaagaaatgaaagtcataataaaatcagacttttatctttcatgggagagatttgacaagttctcttattgttgataaattaaataagtatttttgaaatgttggaggcaaaccttaaaataattaaagcagaagttattataaagtttagccctgtagatgaggaagagttggagaatgctgttttcctcatgaattctttttatatattcctacttttgaaaacattataatatctacgtattatatttgttttataaggttgaattaaaagtgtgacaaaatagcaattttttaaacacagaaaagtttatgcagaaacctcatatatctctaagtgggtttgtaaattgaagcccagcataataaacttcctatgataatgagatggcagacaatacagctgtaaggcatgtgaacaaatgtgagatggctaaggtagaaagcgaaatggggagggaggccagtttgacggagctgaagtagaaactgttgaaggaccaataatgaaatttgctcctaggacaacaaataaattttctatgtgggataataccatgcttagttgtagattgcacggattttgatgacagtaagtaagcaggtgtccatagatcttccagcattacaaaactccacacaataaggtatcccatgaaaccatctattaaacagcaatactaggtgatgtgaactgtaacagcagtgaaagagaaacatctgaggagagattgtttgtatttctttccacaagtcaatgttaatagttactgactcaatggagaaagaattgcactaatcagatagtagcagttatccatggctgtaagacaggaaaaaggagtgaagatattctcacaatagtggtttaaagacccaaagtcacgttcatttaaaatgagacttttgaaactctggtgccaacagaaatgattttttctttagatttttttctagaactatctgtacacactactatagcacatacccatttctttcatattatctatagttgctttagggctacaagtgttggagttgactacttggcaacatgatcacattggtctgcaaagattaaaatgtatactatagtgcattttattgggggaaaagtgcaaaaaaatatgaacagatagtaaaagacaaattaggagatgaaacatgcttcaatcttaaaacggaggtcaaaacaaatctggccccctccagtttttgcatggctcattagcgaaaattaatttgcatttaataagttcagcaaacatttagtaatattgttaaacatttatttaactcgaaaatccgctgggtagatgagggttgactgatctaaactgggcttgcatccatcccacatattgcttatactcctcataagacaaaaacgttagcgtatgcattttcatttccttcaaaagaatatttaattacatgtgacaattaaatgaaattaaaatttgtgtgtcaataaagttttactggagagcagacatttccatttgttacatattatctatagttgcttcgatactataagcgttggaattgagtagctggtaaagctcatatggtaaagctcatatggcctgcaaagcttaatgtacttactctctgacattttacagaagagtttgcagaccccttccctaggaggttggcaagaatgagaactctcagtaagctgaatttagggttatgttgacaggatcagtaggtattgcattttttttcccttcatcttcagagtagtacctgacatatagttgccttgtctgcatttaggagggggatgacacgcagagaaatcccaaggaatcactttgctattttgctttgtcttattttgtttttagctgtcttagactggagcatggggaacaggaaatataacccaaaggtccaccgattaacataaaaattaattatattttacctatattttacatgttatcttttgtcttaacttttattcaataaaatgtatcaaatgtaacaatggcttaagagaagaggcccatgtgaaaaatattacaccaaattcgacctaatgatcaactacaaatcagtatttactatatgtcaagcatggggctaattcctaggaataataaccaaggaacttaccacgtagaaaaatgaaagcccagaagaaaaagcatcaagaagataaattaaatgattatctgctttaaaattacttaaaattaacaaacaggacaaaagactgtttgtgtaaaaatataataggctagaaactatttatggtaaatagacaaagtttttgagctaaaaatgaattacagaatgaaggaaattctaagactggcctaagatagttgcaaagaggaagggggtctaaacccaactgatctaaacatatgaagtcaaaatatataagatgctgccaaaaagaagtcagaaagcattcagtaggatgttttaaaggcaagatgattactcacagaaccttttaagataaaactcagataagtcgaggcaagaagataagaccataagatttacattaagaattaaaaaaattaaatcaatttaaaattggatatctaataaattttttaaatgagataacctgaaatatttataaataatattttatttttaacaaaagtagaaaaattgttaaaattatttgcgtaaattttaatatatttattcatatatatttgtatataaatttatatatattacatatgattttcataatatgataaatttacatcatagctaaaagagaaaatcatttcatatagcatactagatttgaatctatcttctactaataacatatctggaattcaaatattaaatatggaattttatcaggagactaaaatgatcttctgtgactcactgctagagaaactgatatgttaatgaacatcattttattaacatattccaaattaattaatactttcatcattctaagaagtttaaaaagaagcatctgtttgatatttactagagatgatttggtagataacctgcttatgtggttcttttgttgtgaatcatattttctgacaaatattctaaacatttcacttcagaatattttattgtttttattatcacacaaaattattacttgggatttatctattttgtagattttcttcctatatgcacagttgacaacaagataaaaatggtatttctattagcccagtcaattagcatatttatagcagattttataatgcctttatcgagatatgattcatttttcataaaatttccttttaaagtatgtaattaagtggctttgagtatatttagcccaaccttcagcattgtcaacttttagacaatatgcattactccaaaaacaactccatacacattaacagtcactctctattcaccgctacccacagcccataacaaccaccaatctaaaaactgtttctacagatttgcctattttctggacgttttcagattatagcctataaagtagatattcatttgataagaaatgccttctaactgaaattattcaaagataccttaaagaatagtcagcagaaaatttaacaaaacagaactatatagaatccttataaaatgaagaggaaaaggcaccatattttgagttgtgcatgagaaaccatcaaatatgattcctatacattccaataatgttaaaccattcattgatcaacaaaagcatggttttacctatatggtatgtcatatggaacattttagccaaggatgacaaagtaggcaagtagtctcctctgggatataaattgtaggttaaatgtaatgaccttcctctaacctgcagaacatgtctcataactaatttagaattaaaaataacactctattttaagttgttattagcagtttagactgtgaaagaaatcgaaagatcttttccaacatagcagcttattgagttcaggttttgttaggaacaagaaggcagagtatattaaaataatccaatggtatgttgtgctcggcatgggaagaagaaggcaataaggaatgaggaagacagagaattgaattcagcatataatgtgttccaatacctataaaaggtagacattaataagtttattttatagataagaaagaatgccaaaggaaataaaactaatgtcacatagttcataattttgcctatcactataaatcaacaaagggaaaataataacatattgctgatacacttgtcaagagaccccttactccacataaagtatgtccagtataatttagagtacaatgtacataaattactaaaaataaggactatagaagttatcatgtatcttatttatacccagcagcaacctggacttactcataaatgtgatccctaaaagaagatacattgtttcctaaagggtcacagtaaaaattatcataaatctgtaaattatttaatgattaaaaaagttttgctttatttgttatgcttctctgggggctaagggtgaacaatagataaaattaacacactttaaatgatttacttgtttaaaatgtaaagggaaggatgaataaagaaaaggcaacagaattcctcgaagtaggatgcactgtagggtatcagatatagttgtatgcatacagagagaactaaaattttgacacattaataaaacgataagctaacatgtcaacatctaagatgcctatatgtactatatacatataaattttgcagggctagaatgaaacaaatggttgaggaaaaccaaaaaaacatacatgtgcacatatatgcctatagtcacactaagaaagcacactatttccagagctaattagctcactataaggtaaaaggggggaaactcctctgtttagagcaaggaatactaactgctttctatataggagcttgttgatggaaggcccattcaaggctggaagccttaccacctactagactacagaggatggaaattttctgatctgtgaaaaatctaaatacgcaacataccttgatgtgcagcaggggcagacatagcaggacagataataagattttaattaagcaagatacttatcaaacctcatgtttttatattccaataacttaaatgcttacatgtcataaggacaaaattatcttcatttttaaaatgtaagtttttaaatataaaaggaaaagctttaagagggtataagcagcatcagtttacactttgttttcagttttaaaagggctttagaatccacagtaataattctgatgtgttgactaccagaaattgaggaagacacacacaagcagaaggtctaatatctcaaactattttgtccagatctatttttgcatgaggctaagtgaaagatgttatgtatgacaagatgtcaaactccacaagaaaatgtatgagaagatgatagttattccttctccaaaaaggaactctaaaagtggcaaatgaatgtcccgtttcaagatacacacaattattttgggatctacatcccataattgctattggtgtggttgggatagaactaattattctttgtgctggatttgaggcattgtagtgtgtgccctggtgatgtcagggggtatcatgagaccctacttggcttatctttcttacacaatcaaaattaaaagttggatgttggcaaatggctagtagtgcccttagacctgagaaaggctgcttctgtcctggtcttacactatgaaaggtctcacatattgcaaatattaattaactaaatagccccagggcatcttttctggctcgcaattaggtaacaatgcctcatctaattgtaggcatctaccctgctaatgaacactttccaggctacagacaaatgctgccttttctcatttgctacatgtcttcaaaacataagacaacctcagcccaattctatgaatgcctgtgggttgtactagtatttatgttgggaactgctttggtgtataggaaagagctggaaaatcttatatgagaaaaaatgcttatataagaaaaaaggcaaattaattaatttgccaaactctcactctgagggaatagttttccagaagtgccaaacatcaatttctaggcctctgcttgtattccaattacgttttcaaagatagccattaattggcatcgtattgcaacagttgatgtggcaattaaaaaaaagtgtgatattaaaaaatataattatttatacgtttacagatatgaaatggtttgcaactagatggaaaatgaattgtataattgcaaatacttttaagaaacagatcaaattatagaaagtattaaggggatattattaaattgaacaaatgatgctttttaaaagctcatatctccatgtagaaaaaattagaaattaagaaattctgaaatgacttaaattttgttttaagacaaagagtaatcactatatatgctcttaaattatataatagaactaaactatttaataatacttaattataatttattatgtgactccattatcattttatacatatttcattttcagtctaagtattgtttgtaaaattttattgacaatctcttttgctaatgctgcagaataggaaaatttctccaaattaaaagtcatggaaaaaactaacaaagaactacaatagctcaaaaattttatgtagcaataatgatgctagaaaaaaatgcaaaagtgttgatgtattatcataattagagactttctaaaattaatagcacatataaatagctatattcagaaaacatactatttatgtaaaaatattgtattcataccttagagaaatcatataacaattttccacaaattctcaagtgtatttctttcattttattgctaatctaatgtaaaatatctttatctcagttttaaaaaaaatcttgtgggtctgagaagagttacccgctactagcttttcacacacacacacacaaaaaaaaacagtgttactcattaaaacttctgatatctgaatcagcagtggcttttattctaaaactttttcaaaggatctgattgaatgtttgtcttataagctattaatatatgctgtgaaatgtcaaatttatgacacaaatgagtgtattttgttatgacaaatgtcaaacttatgacacaaaatgagtgtattttcttaaattaaaatttcaaattgtaaaacgtttctatatttgctcttactaactgaaagattaattatatgtgcatatatgtgaaataaataaaatggtatagtcatagcaaaatacttatttgttttaaaatgacttggaaaaattctaataaacctacacatggtaagaacaattcactttttcaagaagtataacactatggtaaagtttttaaagtaggtaatcgtgacatgaaggggaataagaactacttcaaaagctataattaaatgcattatgtaaaaatttttgaagtacatgtttatacttagtttcaggacttaacgaagcaggatattcccctgacctcttggtgggactcgtgaaggtagtgccgggtttactcagcccacagctctcaactcctcgcaggagggagtgcctgagccagtgaggcgtgaacaggagtacaccagcgtttgagccatctggctgctctggtgccggcaggggtgaactgcactcagttggaccccctgcatccacccctcatggaaggggtcactcaggtgagcaggtacaggagcaggcagaatctttgggtgctggcaggagttaactatgtgccagccctgcagcagcatctgtgggggtgcccgcaaacccggtagccccagagggagtgttacagtgctctttagctcggccgtccatggatggtggaagggttaacaactcagtggaccctctgccttttcatgtgaggtggctgccttccaacagcgagggcaaagggtcagtatgacagtctttcgcttggtggtatccaagctcttgtccaatgtcctaggagaaatgaggtctcatgaatgaattgaaggatggtaaatgcggatgattttcttgccaatggaaagggacctgaaaaggagatagtgtgggaagctaatcttcccctgaagtccggccacctctggccaatttcttctccgaagttatgccatcaagctctccctctgaagtcaagccacttctctccaatgtcatccaaccacagtctcctacacccacctgcttctcttctctatgatggctgagcttggggtttttatgggcacaggatggtgggtacatcaggccatggattttttttttggaaaagggaacattcaaacaggaaaacagggatgtaagttctcactttgggccacagcttcatatttttcggattgagggtgggccctcgccagagacctgccctcatcttcccagaatctccctgcctcctgtccctatcactacaatcaagctcagcttatttaaagttataatccgtagatgtgtaaaatctggaccatgcttttcccctaatattacaatatgcatttttaaatagtttataagactctcaaccaaagtaacctaaggtacctgcaacactaccatactaatgtgaacatgttggatacaaagaacacaatgttataagggtgtcaagtgctaaaatactaaatgtattgagtacttagtttgcatgatatatctattacattaagatatagtattggactctgaaaaacacaaaagaatttcaggcatgaggattccctccattcaagggctaatagcctagttgaagaaacttgaacactgaatgcagacaaaatgacactaacgaagagcagcatataaaatacctacaaagttcaactcaggttaagaaaagggaaatatttttgtgtactagtttgcacatgatcgaatgcatcttggagtggtggaaaatgtgtttacaaatgggttcatatacttgatttaaaaaatccattgctaaatgtttagtttgccattttaatactttagatttatacctctataatcttattctgtccaaattcatgtataatctgtactggctgtctattctaaattaataaaaagtaaattattaaatatcatatttaaatatccatttcacagttttattgatttaactctcaactaggatcttctagtatctccaaatagcattttaaagaatacaattttggggaaaaatgtataaggttatgatctatttaaagaaaaacgagttatttgggccagcatccataatttctatgggaaaaatatctaattttgaacagagagactacatacttcatatgacttcaattattttacgttttttgatacttgatttatgtcttaaaatgtggtctattttagcttatttctacaaacattcagagataatgtgtctttgagtcctgtagaatgaagtgtttgacctaatcaattagtgtttgacctaatcaattaggtcaaatatattaatgtgttgttaaagcattctttatccttaataatttgtcatctacctatcccatcaattactgtgaaattatcattgaaatttaagaatataattgtgtatttatctatttcttctgtaatatctatcagttatcattttgcatctctgtcagtatggataaaaaattcaggacacttattgtactagatgaattgagttctctatcattatgaaatgatcttcatttttgtaacagaattggttctgaaatctactctacctgtatttttgctcttaaattgactacagctttctttttatttgtgttaatgcaatatatactgcattatagatacatacatatgtatatataaattctttctctatatctataattatctatctatctatctatctatctcagagagacagcgctatgtgttcatctttaaagcagttttttgataacatattttagggcttacttttttattcaatctgataaattttgtcttttaattggtataactaggtcatttaaatttagcatgattattaataggtttaagtctgtattgttatttgtttcctattaaaatatttttgttattgttttatacattttgtgcactctcatgaattacattttttgtattatattttatttcctttattggcttattttttcattaatatccgtttttcccattatttttccattttatgataatttattgatctagagtgtacattattacctacctcagtttaaattaatgtgacattctaccactttacaatgaatgtgagaacttaccgtagcattctttattttctcctctccaggctttgtgcaattatcatcacatatttgacttccacacattctacaaaccccatgttatattgttattactgttacaaacaggcaattatcctttaaaggcatttttataatgtgaaaaatctgacatatttacccatgtagtaaccatttctagtggtattttttttcctttgaatagatttatattactatctgctaacttgttttgcacaaaggaaattttaagcacttcttataagatggatttgctggttattaactatttcatatttataggtctaaaacgtcattgttccactttgtttttgaaagatatttttgctaatgataggacactagtaatacaggtttaggctttacctcccttttgatactttaaagccattggtctgcttttttcctctttcactgtttctgatgagaactctgctgtcatgcttatgttatatatctctacaaaatgtgtcttttttgttctgctgatgcttataagatttttatctttacactggttttgaggaattaaattattttcatatcatgaacagaagttatgtttataatttttgatgtactgcaatatggctaaataggacactcacttgctttgaagggaatttgccttttactgatcagaagaaacaaacattctctgcctcctcaaatcttagaagcattttacttatgatatttatgtgttaatcagtaacaatctagtctagctacagtttaatatgaaacattaggaacttggactgttaacacttttaggtgcaggaatatcatgtaattatttttaataagtaatcatttataataaattattttacatttacacaacagtgtaagttttctgtttacatttaatctttagctttgtgctccttaataatatatagttttaattccccaaatcaaccttttctatgatgaataatttgtaatcgtttattttttatttaactataacatttaatttcttggcatacttttaaatgaaatcaagattcaccaagaatttgttataggtatgtaatataggttagtacataaatacataaataagtagatagaaaagcctgggcaacatagtgataccttatctctacaaaaaataaagaaagttagccaggcatggtggcacgtacctatagtcctagctactcaggaggcacatgtgggaggatgacttgagccctggaggttgaggctgcagttagctgagattgtgccactgcactccagcctggctgatggaacaagactctgactcaaaaataaataaatagttgaaagtgagaggaatgggggaagaaaaaggaaataagaaatatctggataggtaaatagccaaatgaatctggcttacattgtctctgaatcaagcaaaggtttaatcatttatgttttgatatattttgacatgtaatattcagtagaattttggcttgaacctcattgttgtttagctaagtgcattcaccatggagattagtaagttcctaatgataatttaattttattcaccctggaagcaagatttttggcccagagaagaagtgattttctgtttttacccacgaaggccagttattttattcctttagttctttttagaaaataaagtgttcccagtgaagaaaagattactaaataaaataaaaaatggcataagaaacacaaagaatattaagatacttagaattaatattctgcatacctaagtcaaaaagttaattaaaactgccattttagtttgaaacagtaagccaatgcctgccaataaatcaaatgcttgctaaactggctttagttaataattatattaggaattcacgactacccagtttatgtatagaaaaaatgaaatgttgagaaaacagagatcaaaatgttattactacaaacttttgaatatgcaagactccacatcaagattaactctaatttctacctcaggattaggcatcactggctggaatttatttccttgacatgatttagaaagatgattcagtaaagtattaaatcattatctcctcttttaaaaaatcatgaataacctgggttaggttcaaagagtcaatttggtgagaattctaggattttgagtaatatttaaatttcaattcaaaatggattcaatacaaaaaagtatatacacaacagctttaagtaaatcaaaaattaaaatgatgaatttttgttgaaatatgtgttgaccagattattcactatcttcttgaatgaaatgaaatcttctcactgttgcctttaatttgtttttgttttaatgtatggaattgcaatcacaatgaaactgcatagcttgtttcctgcctacataaaatcttgtcacgactaaggctccatctctcgcttccagagtgttgctaatttatgctacttgtgtttcttaaaaattacatctgtgagctctgaaggaaaaaatccaggtcataaagctagtaattaggacttacaaaaacttaaaaactttagctaattggatatatgatatcactggaattaaaattaatttgaaattctaaaactgttaaatctaagtattttcaaaatagcaatctatgtggaatgtgcatactccaagcaaatctcttaagacaaattttcttgttattgcattgtcccactaactaaaacacactaaatgagtaagccgttcatgtgttttccaaaattctatgttacttttaatggaatatttcatgtatccaaaaaggaatgacaataatactcataaatttgaaacccaaatgtcatccccattaaaaatagcccatatagattagtaaagcctcttacacaaatctctatgattccatttccctcctctttatcttgtgggtaaccattattctatgtgtgaaggttgttattcttatatatattgctcccaacaaacgcttatctaagctctagggagattgtagtaaataatactgtaaacattttcatgcacatatgttatgtcagattgtgagaagtactataaaaaaataaagaaagcaagagtaattgggataggcagagctatcatttaaacacacacacacacacacacacacacacacaccacaagtctctccaattatatgctccttcaatgacttcattgatcagttaatatttcagcaggaattggaagaaagtaaaggacaaggcatatggatattttgcaaaacagaattacagataaatgttcaaagatctaaatcagaacaatctgtgtttgaaaaatgaggctggtgtggctgagatatgaagtcatagataaattggggtagacaatatagaaatgatgttttaatagattttgattttattctgagtgctatggaaggcattgcagggttctgagtggaggattgatattttccaattcacacttcaagaaaccactttggtagctgttgaaaatgggttattggaaggcaaggatgaaaagttggagacctgtttggagactattacaaatatccaggtaagagaacaatagtgacttgggaccaagtggtagggataaaaattagattgattctgggtataatatgaagagacatttcagagttttttctggtacattagatatctgatataaaacataccattttgcttatacactgctggcagaaatgtaaattagtttcatcattgtgtaaagccatgtggcgattacttgaagaacttaaaacagaagtagctggaaatacaggtgcctgccacaacgcccggctaatatatatatatatatatattttatttttagtagagatggcgtttaaccgtgttagccaggatgctctcgatctcctgacctcgtgatccgcccgcctcggcctcccaaagcgctgggattacaggcgtgagaagtagctgggaggctgaggcgggagaatggcctgaaccctggaggtagagtttgcagtgagccaagatcgcgccactgcactccagcctgagtgacagagcaagactccgtctcaaaaaaacaaaacaaaacaaaacaaaacaaaacaaaaacagaagtagcattcgacccagcaatttcattattctctatatacccaaatgaatataagttggtctaccataaagacacatgcatacatatattcattgcagtactattcacaatagcaaaatcaaggaatcaacctaaatgcccattaatggtagatttgataaagaaaaggtggtatgtataccccattgaatactacacaatcgtaataaagaagaagaacatgtcctttgcaggcaacatggatggagctggaggccataaccaaagactgcatgttttcactcgtaagtggtagctaaacattgaatacacatggacacaaagaaagtaacaacagcgaccatggcccacttaagggcagagcatgagaggagggagagcatcaaaaaactacctattgggtactatgcttattacctgggtgacaaaataatctgaacaccaaatcccgatgacatgcaatttagctatataacaaaccagcccatatatccctgaacctaaaataaaagttaaaaaataaaaataaataactaaaagagacattttctgttttgtgtaatcttttgattaacaaacatttttaattttaatataatccaatgtatcattcatttttatgatttataatttttatatcctcttcttccccaataacataattgcatttccctaaacgttcttgtaaatatttatattattatttctatgatttcaattcacttgggatgtatcttcgtgcctggtgtaaggcagggatacttgtttattttgctcatatgtacaacccctgtcactgcactgtttattgatcaatccttttttctcctgttgagaagtagtgccctatctgttgtatatgaagtcctcatatatgtgtggtttatttctgggctccataatcttttctaatgctctttttctatatttaacatattcaaagcattatttactgaagtttgataaatcataacataaggaaaacaaattctccgctttttcttttcttttctttttttttttttttttttttgagatggtgtctctctctgtcgcccaggctggagtgcagtggcgccctctaggctcactgcaagctccgcctcccgggttcacgccattctcctgcctcagcctccctacaggcgcctgccgccacgcccagctaatttttttttgtatttttagtagagacggggtttcactggtctcgatctcctgacctcgtgatccgccctccttggcctcccaaagtgctgggattacaggcgtgagccaccacgcccggccaattctccgctttttcaaacgctattgcttttgttcttggctaattatatctccatatttatattgaaatgagtttcataatttcccaattattattggtatggttttttattaaaatgtcaaattatgggttaaaatagagatgtttaacatattgatgtcagatttacttatccacagacacaaaatatctagctcttcattaacatgtttcaaaagcatatttaattattcaattacaaagtcatgacattaattttttttttttgagacagagtcttgctctgttgcccaggctggagtgcagtggcatgatcttggctcactgcaacctctgcctcccgagttcaagtgattctcctgcctcagcctcccaagtagctgggattacaggtgcccaccaccacacccggctaatttttgtatttttagtagagacagggtttcaccatattggccaggctggtcttgaactccagaccttgtgatccaccgaccttggcctcccagagagctaggttacaggcgtgagccaccacacccagcctgatgttataatatttaaactcaaaacttctaatagtcaaaaatctaattttaagatttacttattttatgaaaacatgaatagtcatgtacttgaagaatataaatgcttacagttggtaaattataatgagggaaagattggctgaggcaaagttttagtcagggaaagaagatggaaatgtgtgatttaagaaatcaaaaggaatttaagtgaactaaatcagaaaaaaatagtaagtaaagaataatgcttttgtggggtaaagaaaaataaggtgcaaggctttcataaatatagatactacatagatatatacctatttggtataagcttaaaggtacgaaggtattgatacaaacaacccacactggttacctggagggtgtggcattacaagataattggggaagaagagaatattaactattatttttaatataccacagtatttttacctcgcatttttgataatgtattgttacttttaaaattagcaaatagttaattaaataatttaaaaacaaattagtgagaacatttggtagcagctggccatcagctaacaactctgctgttaacatttgtaataataaccaagatttcatctaacttcctcttccttttttccctaatccacaaaacacagatcagggaaactgagattcattgtttaactcccatcctcctgctctgcaaagtattgcctcaattaaatttttaaaaattaagagtggaaaatataaaagatgggaaaaaaagtggaaaaccagggtaacttacaatgagacagggagaaacagagaaaaaatatgagaaatgaaaacaaaatttatagaacttgggatttataactgtcgtaaaaagccatagatagtacattggcagagaagttacatatatttacaataataaagacacattaacagaatttttaattctgtaaaataattttgcttaattacttgtaatagagaaatgattttcccacatgatataagagttgagtgcatggcaaaagtagtttccatgtcaacttttattaatcaagttatatccaatgtgttgatactctaaaataacattccatagtcacaaataaaagttcgtcattttttaattttgtttacttacttatatatgtgtttattttattcacagtagtagtatctgatctctttaaccctatgctgaaaattcttaattatggaaattaattaaagtgattaacatatatccaacctagttaaggagtttgatattactgttgtaaagggaggactgagccttgcaaatcaaacataaatactttatttagaaggccctggatttccaattccttaagattgctttagtgaaatattaaaacataaattagaaaagataaatacaagaataaacatacagaaacatatcagtgcctttaaaattctgagacaaaattgttttgattaaaacatttaaataatttttcagttttaatgaaacaggaatttcaatgctgtattataaacattttaaacattatgacatataagttatttatatcttgtataaatactgtttaataggatgtaggtttatttttggcttttgttttgtttaattttgttttctcttgggctttagtttgtttccagagaattccttactgattatttaggaaaatggaatgaaattatcctaggagatcctaactaccatcgagaagttcaagttcagttcacaaagactccatcctattgagttataagtttatacaagaaaataaatctaccgatattaattgtctctgcaaatttgcgtaaagagaatgtatttattaagcacttaatgaaagtgcaatgtatttaaaaactgaaatttcttttcagttaggtatattttgtaattggtaactatgaagataggtggttataagtgggagcatttactgtgcttgaaaaattccgttgtatcattcagaaaaaaataattttgccaccattacaacaaaacttcataaagggttatcttctgttaaaaatgttctcgttgatttctgtcacatcttaatttctgaattctgtagatattttacacatccaattttacctcagaagagtcattttgttcccatatttgtgggtgatttccacatgtgattttgtcctagtcttggtttcacataatataaaagcgatgactataatgatggtcatacaatttgaatctctccatcttccttttagaagctacacacatcaacaggaaaatcaaataccatcactcttatccagatttacagaggaagcaggagacaaaaggatctcaatttaattggagaaataaataagagctgctgagtcagccccttagcagagaatcaggcagggcatgcacagataaagagtttgggccctttaaagtggataagctctgaaaatatacccacagcttacacccagaaggttattctccacacctaagtgaaacattttaaagtgaatttgagttctggaggttcagaagaatagttacaaggaagctaaaaagaaagggcttggaaagtgtggaggttcaagctcacagttttggaaaagaggcaccttggatggtgatttctggttttgtaaagaaggctaataaagaaaaaatggccctatttatacaagtactaaaggtttagaagacagacagaaagcactattcattgaagatatgactcttctctctagaaacaatagaaatagtaaaagaaccaaaaaaatcaaactaaatatgccatctaacccttctcccatagggtttctaactgtagctgatctagaaaaacaacacaaatgtgtgtaaagtgagggtgtggagaagacatcagaatcaagcatccttaaaaagtaccataaagaacagaagataaatggaccaaattgtctttcttattgcttttcttttttttttttttttttttttcagacggagttttgctcttgtttcccaggcgggagtgcaatggcgtgatctcggctcaccgcaacctctgcctcccgggttcaagcagttctcctgcctcagcctcccgggtacctagattacaggcatgtgccaccacgccggctaattttgtatttttagtagacacggggtttctccatgttggtcaggctggtctcaaactaccgacctcaggtgatcctcctacctcagcctcccaaagtgctgggagtacaggcatgagcccctgcgcctggcctctctttcttatttctaagtgactatatttaagaaaaaaacaaaacaaaacaaaaaagaacatgttatacacacacacacacacacacacaaaatacctacatgctcattaaatactattttcctgtgccatctaagcatatgttacagctgttaacactattctatatatcatataaaatatcttttcccctggattataaaggattgaaaataacatttattaaatatgaaagtttcaatcagtaggaaataagttaaagtagaaacaacagccagctcagtatctacattgttttatagctttattaaataagaatctgcttattagtctgaagtataatggctaaagtaatatatttatactctcatcctattaatcacaactccttaagaaaattgccaccaatagttttttcctctacaaataagccaacaataaaaagaggtaaaatatagatgataaaatacaggaaaaatgtagaagagatgcctgagcacaaatagaaacaattaagaatgaggaatattgagtatagaaagagaaacggaaaagaaatagaaataaaatcacacattaaaaatgatcacaaaacaggaaaatgacatatattgaagactggaaatagaacaaaattaatatttttgttctattaaagaaatccttcctgaaatggggtcagggactttgaatctacgtaattcaaggtttcagaacttgccagggaaaaataataatactaattattattattaattttattatatttatttattttttttgagacagagtctcccactgtcacccaggctggagtgcagtggcacgatctcggctcactacaagctccgcctcccgggttcacatcattctcccacctctgcctcccgagtaactaggactacaggcgcccaccaccacgcttggctaatttttgtttttgtatttttagtagagatagggtttcactgtattagccaagatggtctcgatctcctgacctcgtgatccacctgcctcagcctctcaaattattttttccagtcaaagtataaggacctccaagtaaaacagaccaagtcacatacacaggaaagaaaatgagacatgagtcagaattctggatggcagcacacagggtatgacagcagtgaagtaacaagaagaaatccatgatttctttcactggacaagtatatatccacctaatctgaccttcaagtataaactctacagaaataaagttccaaatatgccacaatagaattaacattgtgcgcaagagccactattaccagagaacctaatagagaatgaccttcattccagaaaatatgagtagaaaaaaaatgagcaaaaaattaatgtagctgaagactttagattaaaataaaagttgggggggagggataagagtaaatatgtatcaggttggtgcaaaagttattgcagtttatggcatttttttttttaaatgatgaaaaccgcaattacttttgcaccaacttaatatggtgacaaaatagaaacatataactaaaatatggacaaagaagggagaggagacaaacagaaatcactcactgattgcttggtaggtaataggtggaagtttaagatataattcaaagctgacaaacaggatagcagaattgaaataagggaaaggtaataaggctactataaaaagttttagtgtggaggcaaacactagaatgaaacagaatttcccaaagaaaaaagtaaaataaaactctaaaatttaagattgccatgaaactgaaaacacaataaataattcagtgtatatataatacaaagtgtatagaagaactgagacaagaggtccgttgtactgatgaatggaaataagcttagctcacttattaaaaacaaaatgtgttgttattggcatatagacgaaaacttgacgctgttatataaaagacacattttacttgtaattggaatggataaaaataaatggtcaatatcatgtaagacaaatgtgaacaaaaaataaactgagggtggtgatagggatatctgacaagttataatttacatcaaataataaaatggaacaaagtacgacaccaaacaacacagctgtgaggaatactcttcataatgtcaaacaattaaaataaataaaaggagaacagaaatgcactagttatatgcaaccttgacacatttctcttagtgcaaaacaaatcatgtggacgagaaatgcataagaatatagaaaagccaactgatcaaattaatgaggtagttattgtggatttttagtggatatataactaacaattcagaaaagtggcaaagtaaacaaaatgagagaaagacataagcaaaatggtatgttttaatagagaaaaacactgaggccaataaatatgctgcttctttgaaaaatatctaaattcagaaaagaagtcagaaatgtacacacacacccaaactaataaggggaaataaataattggtactgtaaaaattgatcatatgattgggtctttctttacataactaactgtaacagagtcaagaggccaggagtaaaaagcactccgggcatgtatcagtccgttttcacactgctgataaagacatacctgagactgggtaatttataaagaaaaagtggtttaatggactcacagtaccaagcagctggggaagcctcacagccatggcggaagacaaaaggcacatctcacaaggttccagacaagagagaatgaggaccaagcaaaaggggtttccccatataaaaccattagatctgatgagacttattggctaccatgagaacagtatagggcaactgccccccatgattcaattatttcccactgggtccctccacacaacatatgggaattacaggatccacaattcaagatgagatttgggtggggacacagccaaaccatatcagggcataaaacattactctaagaatgtaattctctacaagtctaatttctgaaactgcctgttcttacctaaaagcagttttatctaatagctactgaaacaaccagctctgactgtaagattagttttacccacctctgtaaccaatcagaacttgcctattaactttctttcaaaacaataagtagcatttctcctttttataaaatctccaaacttgtctttgttctttggacatactgaagaccacctagcctttgtgtttgttctgaattgcaaattttcatttcccaaataaaatattttaaattgagagattgtctgttacagacactggaaatttaaaacaacaaatttgaaagaccaaaagaaaggaaggaaggaaaccaattagtcactttttctaagaaaatatatttcataaaaactgactgactgcagcagagacaggcttaatttgcaattttctaagaagtagtgggatttatctaagacctctttcctacccacactaagacacagtctcatatattttcaaaggggaatcctaccacatcttcagaaacaagataatcctaacaacattttaagaagcacagaaaaatgaaaataacaatgatacctgtgatagagtgaatggtggctcaaaaaatatatgacaatctcctaactctgatcttattgatcttgtttggaaaaaggacctttgcagatgtaattaagttaaggatcttgagattcagagattactgtagaatatccaggtgtgccttacatggcatcacaagtgttcttataagaagaggctgagagaagttgggcacacacagagagcacaaggctatgtgaagatggaacacaaagagatgcggccacatgtcaaggaatgctgacagcccccagcaggtggaagaggcaaggaatggattatctgtagagcaactaaagggcatgtggctctgctgatggctgagttttggcattctggccccaaaaatctgtgagaactagtaagtaactattaaattaccaagtttgtagtcatttgttagcagcacaggaaactaataggtacctaaccctgcgaaaagtggaaagaaaagagaactgcagagcaatataaatgcaaaaatctgaagcaatatgttaaaaagaacaatatactggcagatttttaagaaatgatgatggatacttattctaggattgcatgcaaacctcaatattagtaaatccattaattcagcgatgagaattagaagaaaagtaatatgcagtcatgtgttccttttttttttaattaccaaaaaggcaatgtttatttctggttttcacaaacttaataaaatagaaatagatgttttcttaatttgattatatatatatatattatatatatattatatatatatatatatatgtaagctggggcttcagtaacttaccatgaagtctggactgaatttatctgtgacaaattaattattatcatctttattatctatgggtggggatagcctttgtagctatgactcagaatcaagtttctgaaacttttaattaattaagccaaaaaaaagagatcctgtaaataaatattaatctatttatttatgtagatgcaaaactgcaaatgttaatgataaactagattgtgaatgcacggatgctcattgttctattctttctacttttacctatgttacccatttttttccagattaaaaaagaggtatacttcaatgagatctcctttggtgcccaccaaaagcaagtttagtgataattgtgtatcacgttttgtcccaattttaaaaaggagaagaatggaacattccagatcaagaggaaaaagatatagatattatagtacaaatctaggataaatagagaatttaacttttagaattcactcgttatcttggtagtcataaatgaaaagtgctagtttaatggggaaaggattccctatttcataaatggtattgggaaaactggctagccatatgcagaaaactgaaactggaccccttccttacaccttatacaaaaattaactcaagatggattaaagatttaaacataagacctaaaaccataaaaccctagaagaaaacctaggcaataccattcaagacataggcatgagcaaagacttcatgactaaagcaagaaaagcatttgcaacaaaagccaaaattgacaaacgggatttaattaaactaagagcttctagagagcaaaagaaactatcatcagtgtgaacaggcaacgtacagaatgggagaaaatttttgaaatctatcaaagggctaatatccagaatctacaaggaacttaaacaaatttacaagaaaaaaaaccaaacagcctcatcaaaaagtgggcaaaggttatgaacagacacttctcaaaagaagacattattgcggccaaaaaccatatgaaataaaagctcatcatcactggtcattagagaaatgcaaatcaaaaccacagcaagataccatcttgctccatttagaatggtgatcattaaaaagtcagggaacaaaagatgctggagagaatgtggagaaataggaaccattttacactgttggtgggagtgtaaataagttcaaccatcgttgaagacagtgtggtgattcctcaaggatctagaactagaaataccatttgacccagcaattccattactggttatatacccaaaggattataaatcattctactataaagacacatgcacatgtatgtttattgcagtgctattcacaacagcaaagacttgggaccaaccaaaatgcccatcaatgtcaggctggataaagaaaatgtggcacacataaaccatggaatactatgcagccataaaaaagaatgagttcatgtccttcgaagggaaatgcatgaagctggaaaccatcattctctgcaaactaacacaggaacaaaatatcaaacaccatatgtcctcactcataagtgggagttgaacaatgagaacatatgggcacagggagaggaacatcacacaccggggcctatcggggggtggggggtaaggggagggttagcattaggagaaatacctaatgtagatgatgggtggatgggtgcagcaaaccaccatggcacgtgtatacctatgtaacaaacctgcacattctgcacatgtaccccagaaagtaaagtgtaattaaaaaaaaaaaagaaaacaagagtgctagttttatttttttattttaaagtttctatttttataagcagacacacaaatacacatgtacatctttatgtctcactattaataaaagctgctcatctcctaaaaattactaataattgggatggcctgttaatttaaagttgctatatttaggaaattggaaaataaatcaggaagtgaacattcctgatatgatacaaatatcatagtaaaagaaaaataaaaacatttattgttaattgattattaattcaaatgaaataatagagatataaaacattgtctttaggttaggtaataaagtaaaacaaagaaattgccaaagtttattagaaattagaatctcttgccaaaacagcaaggaagaagaaatctaaatccagctctgctgtagtaacgaaagtgaaagtattgtcaagtattctcatataatttccatttcccatttgaagccaccttaaacattaaaagcactattctatcaatttgattaaaattgacaaattgttgaatcataaattagccacaaatatatttgctagcactgaaaaacattcagaactacgctaaatgacatttaaacacatattcatctcgtgacagatgaaaagggaaaataggaactaagctgaagatgatgaatatatttaatatttcatactgattctatagattcaaatgcatagaattaaacggagaaagaagggaggtgaaggaaaaaggattgactggaaaattaaatatgaatgaaactcccaaaaaaagaaagggaacattaaagtcccaatcatgcctattgggatgtctaaatttgaaattatacaaaaattgtgaatatagacatgtcagtgtcaatgtcctgctttctctctgctttttctttcttcagtgttcacctaatgaggcagaaacgtctgtttaagttcctagactggtgtttgaacaccttggttttcctgctttttttttctgcatccatggtaaataatctaaattacagtgaataaaagggatgaaaactcccaaccagggaaaaataccattcaactcctctgttaccagaaaatgaagtgtgaaccaggtctcagttcaaccttgtttgtattctgacttctgagacacgggacaagctactcaacctttctgagcctcagtttcatctttaaaagaaatattaatagtagtaattatatctgaaagcccatactacataaaacaatgagacactgaaaaatacatatgctacaaaccatctgaaatcaattgtattctttttgtggtttgctttatatactagtaagagttgtttgggattccagttaatgtggtaagaaatgaaaatacacaatttatctcacttcctgtcaagctctattaaaaagaataaatgttaaaaacaccaaaaaaaatccaagagcttcacaaatgtaagcatcagatgtaggtaggtgatgaaaacaggaggatcacgtgcaactttgcatttcaaacttcttggtcctttgattcatttcatacagttgtatcccactacccctcctgtaccttaagaaaagactcaaataaagttactctttggaaaaactgaatcagagaagcctttcacttgagaaacaccagacacagatgagagtggtaagtggggacatactagaaacaagaggtttaccagaaatatttgtattaaacagcagaaaggcacacattgcttctgttcagtacctagaatgctggtagtcaggcctatgcctgaggccatccagtttgcaaccattcctatatggggagtttctaaataactttttcacttttcagtcttaaaaatgaatgaactaataaataacaccatgtagttgagaagcacattgacatacacacactcacacgaacacacacacagaaacacaccagtaggaacaaacaaaataaagaaacctagaaaaaaaatcatgtttatgagcaaagcagtttctcaaatatatagagagatagatatgtgtatatatatatatataaaacattctcagagaaacaaaaagtttatttaataagataaaaataagttctaaaaagaaaacattcagagaatgagggttctagagaaatgtttttaaaatgatagaagaaaatctatgtgaaaggttagaagagaaagtcaaagtgaatctcccaaactgtggtatcataaaaacgggaagataaatatgatcaaagagggaatgtgagatccaatgaaaaagagttctagcatgtggtggattgcattattggtctcaattgttgagcctcatcaacatgcgcatacttgcgatggtctcatcatgggtggaatatgtttcttttctaatgttacataaatgaaagcaaaagtgtgctaatattaagcctgtgtcttaagaggctttattgtttccagttgccctattgtacatctgccattgccatgtgaagaacatacctagctaatttactactctgagagacatatatggtgctgagtctctcgaactgactcacacagacctgtagtgtgaagcagcaccactcagctaagacttgtgaagcaatcaaaccacagtaagaagcagaaaagtgagaaaataaatgagcattgtaaaggtctacattctggggtagtttgtatcacagcgactgctaacagaaatacagagagacagataaaacagaagtcataaaatggtcaaagaaataatttcaaaaactgaagagaatgtaatgttgcaagttcaaaggcataaagaagtgtcaaacacaatgaataataataatgattataataacaatacaaatcaagtaacaattatgatattaaacaacaaaatggatatgaaataactccatactttctggaggcattggtaagtgtagtaaacgttttcatataaaccataaagtgagaaatcattaagtattgttaatagcaacaagtatctatgagacaactgtagagaaatgatttaaaaactctatggggaaattattttcaactgagaattctatatccaggcaatttatactcaagggtaagagttgaataaaggcatgatagaaatgtaatatcatagaacgtttaagtcccagggatgcttccttaataagccctttgaggaaatcattcaacaaaaaagagaaataaaaaagtattgtttagactatgctgacatgagatcctacgtctccagaaatgcttcaggcttaatgagcaatagaatcaaataggcggaaacaagaaaatggtatcagcaaaacaaaatataaatgattgtaaagtgtgggaacaaaatagattccctgcaaactaaaccgaagaaaaaataatgcaatatttttctaacttcaggacttaaaaaatagttgtgaaataattttttaaaatagtcattaaaaccatagaattaagattagaattatgttcacataattaaaatattataaatttacaacttgttacattagagcatcagaggattggagtaagggaaagtgtgttgggagggtttttatagtggagtataaagtgtggagtataagtgtaaggagtctaaatccttgtttttcacagctgaaagtctgcaaataatatcaaccattgaaaaatcaagagtcacacacacagtagcttccaaggaagagctaggataaaactggttaacactgggttgtgtgaataatttgggggagaaagagacagagggttgttaatctgtttcattatgaattttatggtactattcaacatctaaatctggatacatattacttgataaaattgatcttaaagaaaaaacaacagtttaaaataattaagaaactaaaatacaaagtgaaaaaggagacagggggatcgtaattccataggcatctaatgacctggctaagctagttctaaccttctcagttgtcagaaatcaaacatggaactgcatttttcacaagactaagcgcaaaaacttacagagtaggttagattttttttacactaacatcactctgtaataaatatctcatctgtgaaaaataaatcaagattcacctatattttcaaagtacaattctttaaaaatatttgttcttccatatcctgggaaaatgtgtgttacaggatgagtttatacctgcaaaatcatttccaatttataaaaatatggggcccgtgaataattactgcagcagacaaaaacacaatttttttcagtaggaaacttgagaatttttgattaagtaaacatttcaaagtgtagaacttcttactagttattgcagacatctgaatggtgaaagggcaatgattaactacggaaatgtatttatatcctcagtttctgtctgatgcaaatctctcaaaatatattaataatcatgattactaatgtctaaaatattttcctgaaggtcccacaatagttggaaaagtaatttataagaaagccaatatactcagacctctttgttgtgtacttaggagaacaaacttcaaaattgaaaacaataaattcagttgctgatacatttcttaatttttcattctactgagattaagaagccaccctattcaggaataagtaagaaagaattaattgttaattaaacagaattttcaattcttttatcaggtttgattctatcatcttaagtagacaatcataagctaaatctcatactttatatttaatcccaatgtgtgctaatgaatatgcttaatataatatttgtaatcaaatttatagatagatctaggcattgattgaggtaattattctcattaaaggttgcctttaaattgagtaaaaataattctaaatatttttaagtatagagacaatctcaaaaatgtcaccaatcacctcattctcattgtaaaacctcattttacatccaaagcttggcttgctgcctattctgtcaatgttccagtacagaatggtaccactacctgctattacaggactttaggattctttttactattttgtacaatgttggttccatcagaaacaaatgcggatttgcaagtaccccagaaacctaagctggacagaatttaacataacaaatcataggagactcatgacaacaggcaataaaatacaaagagtacacctacaatgcagtgtctatccatatgtattggagttattagaaagattgccctgtctaaaatgagaggtcaaaatatggtggtgaggaagatatatgcaaaataacaggtgaatacaatttttaaagaactaaaactaaaaagggacatgaagaaaagatagaatactttagttaaaacgtcctatacaaaacgaaatatatgataggaataataaaattgtatagatttttatattaatcttaaagacctgagatacctattaggactatcactacaaattttaattatcttctttgatggcaacatttcatttgtctttcaggcttctcattttaagaaaaggtgaatacgagaacccttgggtcatagattctgtttttttcactaattttttttctgaggacagtaagtgttcagttgtgccagaagaacattacagtgttcgttttcacttccaacaccctcaaaatacattaatgaggacttcataacatcaccaggtaagccaatcattttgagtgtaggtatttctgaggactctgggaacatataaacaaataaaataaaaaagacacgcattaaaacatggcttaaagcattttttttattttaacctttacttatttagaaaatccttctgaggaactaaggggatatgcaatagtgttctataatatcaagctacatgcataatgtaggtaatgacttctaatgtaatctggaaaatccagttaggctgccagaagaggaatgaaacctgagacaagctaagagtgaatggacagctcagctcagtgcaatcataacatataattatttcccaggctcgtttatacatgagaaaagtttatcaaggtctcaaagagtctgaaggaataaaaaaaatggtcagtgatgagaggcactgtcactttggataacagattacactcactcttaggagatggcttaagacaacaagtagagcaaagttagaaataggctacaggcatctgctgagtttgacagccctgaaatcttcaggaacgcacctaatagcctaataccagtgtagttgagccctctccggcatttacctacagagttaaatgatcagaactcttttggtactaaaggcaaattatcaaagacatcaaatgttgtacaatttttttttactggtacattgttcaaattcattgcaattttcagtagttctattgtatagtcttgatatggtcacttaaaagaagtacacactttctgctaccaggttttcttttcaagcactggcactttcctagttgtttgataaggtatatgtgttactgtagaatctatttttgtcttgtgtgagctcacatcaatgctattgacactaaaaaagagactggttccgattatccagctaagcaatctcccatatcacctatcacctctaatcctctgacacacaaatgttcttccaggtctctcaaatatgaataaaacatgtgaaaattatattttaagaattagatacatggaagaaggggtaagaactatatatatatatatatatatatatatatagtatgatcctgacataccatataagctaactctaacatttacatagagaattgcaaaggagatttcagagagctacaatggcatgataggccaggaagttctcaggaatgagcacaactcgggtctaaatatgggttttctgaacctagagcccatgctcttttcattatgccacactgccctggcctatgtgtgtcgcattccctcttcctctaaaataaaacagtttggggccaagcgtggtggctcacacctgtaatcccagcactttgggaggccaaggtgggtggatcacgaggtcaggagatcgaggccatcctggctaacacagtgaaaccccatctctactaagaatacaaaaaattagccaggtgtggtggcatgagcctgtagtccaagctactcgggaacctgaggcaggagaatcccttgaacctgggaggtggaggttgcagtgagccgagatcgcaccactgcactccagcctgggagacagagtaagactccgtctcaaaaaaaaataaaaaaataaaaaacaaaacagtttgagttcatactgtggcacattaaaatttaaacaaatattgtaaaaaagaattcattcagaattcattttaagtagtaaatattgtaaaaatgaattcattcagaagctcatgaaacatgtgtgatactaccaaagatccaaaattaaatatacacagcttggttcaggatgattttcacggagaaaacctatattatttttagctccgattctgagttgacatctatattaagtgaaaagccaaatacaaagtgtgtgcatgtacacatctatctattacctatttatctaactatgtttaatgattatctgattgtttctaaacacttgaaattacacagctttagctatatctctcaagataggtctctgttctctattttgaaagaaggcaagatatcacaacatattccaggatatcgaaaaatgcagttatatctgaatagttataccaattgtgaataaatgtattttaagtattgatatgactaaatagtttattagtgtcttaaaaatgttgtatattagaaataaagagatatttttgtctttccatttttgcatacccttttattagacagaataatactctgattaagacagttatattcaaggatatccttgaatgagggtaagtttgaaaaatgattacatacctattttaagtacctttgaaactgcattttatgagtgcctcttaaaaccaaagacgagtgtaaatgccattgtgttaagttgtctctgaagtaaacttaattatccacatgtttggcctgcacgttaccttgacccatagccagaaactaactcagggaaacttcagagataataggaccctagagggcagatacaggccaaggttagagtacagtatttgtcccatcctgaattcacctaggaaggtttgctgtataatgcttatgttccaattttgttacaggaatctagattctggtttcctttcttatcctaacactaagcccacaatagaaatagtgaataattcattctagcattcagaaaataatcaaaatgcatttttcttatcaatatattttgttcttttatggtgtatactccagaatctgaaatgctgcatttaatgttttcttagtaaacctctttgattttgagacaaaaatactgaactaaacaaccaacaaaccaacaaaccccccagaaacaaatttccactggcaacatttcaacagtattaatcatattaataggcacaaaaaaactagtgttgttgggtgatgactaacctagctactgaaatataagtcaaaaacattcagaataaaggatgtcagacaataaatcttgatatcctagtaataccttcaaagagtatatactatttcttaaatattaaatgcagagtaggatttacctagaagaggccttggaatacagaacagtaaaggtagagaataagcaagggctttaagaatataaagcactatctctgcatttgttgaatttatattttaattttaaaaacatataaatacaaataaactaaatacctctacatgtattcattgtcatatctaaaagtaagaactagtctaaatctcagagtcatttgagggttaagcaagctgagacattattccctatgaagcatttagccctgtgctttcagtctgcttttccagtctctgcatgtgtcaagctgaatgttgggacatcacatgtgaaaatacaagatcatcagcaagaggataggtggattagatgccctcccacatgataacattttctgatttgaaatacagacaataaaatattgttttcttactgcagcggatctgacatagcacctgtacatgcatgtttaggttttgtaatagaaatatgacagaaaagatgctgagtaggaagctatgaaaaatactcaaaagccaacctctttatggtaacctcctagcttgtttaaattaccatgcctacctcttctccagccttgttcattttctcagccacttccttttcctgaactttgattctgatttgatgcatgcatatactgaaaaaagtttgccaccagtttgggggtttcggggggtcaactagattctatgtttacttctcagtcccatttccctggcttcaactacaattcctctagatgataatgctggatactgaccctgactatagggccctttccacaagtgactgcaaacactctcccaattccaattccaagccaaccttcatgctctcctacctctataccttaggtagtgcatccaccaggcttcttcttgcattaaaataccattctttatatcttgaaataaaagactatccctcgaggatatctcatttagcttctgctatatctggagaatctaagagtaccaaattatgaatatttgtcattttcaccccttcacatcagaataaaatcccatatacaataaaaaggaaaaaaatgttttttacttttatgtaattataaaacaccagagaagagaaatttttgtcttattctataaaataattcaaagaattttaaagaaatgattccgttgaccagaccataacatagaaagatattatggatagttatatttataagaatgtgtctcattcaatatttaaaacaaatctgcacattattattctgataatctaatactaaaagcttcatttatgatactatgtgccatttaaaggaacttttcagaatacatgcaaagtaatttagcttataaattaagaattgcttagcaaagttgtttttttctttttttattaacagtttaaactgctggatcagcccttaaatacaaagtaagttcaataatatataatttccccccaatttaaaggggattacagtattgaaactgagaaaaacaaaactataaaaaaaatcgaattgtaatatcctatgtaattgcctttttgagttgttagtaatatttctatcttagaagtttagctagataggccgggtgctgtggctcacgcctgtaatttcagcactttgggaggctgaggtgggcggatcatgagatcaggagatcgagatcatcctggctaacacagtgaaaccccgtctctactaaaaatgcaaaaaaaaaaaaaattagccggatgtggtggcgggtgcctgtagtcccagctacccaggaggctgaggcaggagaacggtatgaacccaggaggcggagcttgcagtgagccgagattgcaccactgcactccagcctgggcaacagagactctgtctcaaaaaaaaaaaaaaaaaaaaatttagctagataatcttttatattctattggcaaataaaatataaatgatactgaaacacttgtcaagcctcttaaagttttgcttttcctgagttttattacgaaattaatagagtatatataaataaatatacatatatacacacaaacacacatatttatacacatgtatacaatgtatatatgcatacatatcttcatcttatgctttatgtaagtgcttacaaatagtacctagatattgctctgtgccctcagttaatgttgtgtgttgcgtggtatattatagtaaaagtacaaatggtctttgaataagaaaatctgggttcaaacccagtaggccgttttctgcctttacctaagcacaaactaatatgctttcaatactcatctgtaaaatgaggatagtaactccaacccagcaaatagactacacccaaatataactgcgtcttgtggaagcatgcagtcatcatgaattgtatattattatttatagttcactaactacaatgtaaaacatctctggaagataaaatattcttctgtgtgttcacactatatttatccttaagtttttttcaagattacaattcagatcatgttataccaagcaaattctagcattcagatccttaatatgacactaaaaaacagctggaagttaccatatagtatcaacaattaccatttgtgaaaaccatagcacaattctaatatttaaaaatcattatcagaactatcatacaactttagacatttcaatactgtactgtttcttcgttgctgtgatagattattaattgaaaaaaaaggtgaataagtatttttgcttaccttctattcaacataagaataacatactctaattcactgagcatacaaattagtatagctctttttgaggacaatttgcctgtataaaaaatgtaattatttattaatgacctcctcaatttcaaattaatctattgatatgtttatagacaaggcaccccacaagaaatgataacatataatttaccatcagtagaggacttgttttaagaagtcttaagatatttgtgatttgagtgttaaattaagtaagcaggaagccatcaacctgaggctgtcttcttacaccgagttcctacgtaatgaactacaaccttacttagtatatacataaacgaactaaatcttgatttagtattataacagtttcaaccaatcacagatagccaactcatcatggctgttaaggtgggcgtgatagggcatatgccagttgtagtcaatcagataatttttctatatggcttcaactctgcttaatttatctaaagtttttcttctaacatgagaaaagcaaaatacataatagcatctatggatgtgatgctttttggcaaacaaaaaaaaatcatgacgtgtgtgcttataagttcatacttttatttgcatgtgtattttgaaatataacaggaaaatattcatagtagttacctatggagagagggactggagaggcgagcaagaaaagttatctctttgctttttgtctgtacatgtggtttgaaatcttaaaactgtaaattttatattttaatggtgaagaaaatatatgaacattatgatcatttatttccttcatgcattctgtgttaaacgtctcataaataatgcaactgttgaattcaccaactcttgtttatcctgtgtttgtggtataaaatgtcatttcatgggagcagaaaccagtccatttacctttgggtgcttctgtttaaataggtgggaagaaaaccttattgaatattttcaatctataacactaattatgcaatattttcaaaatatattttggataaaaataaaattacctaaaacttttattggataaggactgaattatgtaagaatcataaatttaggtatgccaatgagagtctaaattgacagccttgtctggttctgaaaaaaaaattgctctaaatcatttttggaaaccatagatgatagatgataatgctgttgagtctggttctgtgaacacttcatcttgtgaaagttctgagcagtaactggtaattagtattagaggctttatcattcttcctgagcaaattatcagaaagaatgctatattttctgaatgaaatcaccaattaatcatgccactgagcttaactgtaccactagtgaagacatacaaatatggtgggaatgtttctttttaaaagactgttgaataccaaaatctagaattacatgagctgagcatacaatgtgaaagtacgaagtcctaaaacggcatatcacaaatttctgtttcaaaaggaaaggtgggaagggtatctatacttgaatatcctaaaaaactcaaacattatcaaagtaattacagaaaactgagtcatttatttagggcaattcaacatttttaaataaattaggaattattaactaccacatgcttgttgccacacagaataatcaactaaaattcaataatctttgttgaagtagcttgtactcattttgcattaatatgcaattaaacataaacattgatgttacatgatcttatatgattttttgtgtaccagatcatgtactcttacttagtgtgtccatgtgtgatatgtgtaaagcagtttttcttgatgcaaacatgcatcgctttttactagatgacagtttttagagaaaaggcatggagttttagaattaaaacctactcagtgttctttgcaatctgctgtgggtatccaagaagggccagacccttcttatgttttcaggagagaaaacaattaattagcaagttccaatatgtttccaaaactaaagctaggatagggtggatgacctggtaccaagatacccctgagggcccgacggcttccttttatatgctgatgggtttcattatgattcttacagaaagaagccagacatttttaggctagactgcatatggcaggttaaaccaataatcctcttttgtatttcccataaatcattttcaaagttaaaattgtatttgcagtctatatactgaatgtcactgtatgtgtcactatattaataagtcggctaactattctcttggattagtatttataaagtagcaatatgtcttttagttttcttagatatttagaaagcacaggcttattagatttctagtgatctaatcctgagtacaacataaggaatcattgcacatgcatatatagaggattaaaccactttggaaatattagataatatatatttggttcattataaatcttgtaggattctgtattacctaataaataatggaatcttccacatgtgttttcagtattagtttattccaaagggatcctttaacttttaaacatataagataaacttttaaatggtttgattacaaactctaaatatattgacattgatttgtgaatatcttctcccttttaaatgcaatataccaagaactcaataaagccatagagggtcttcacttgcaggttctgctgatgactcgaatataataaagaacatgtaataatgatacagtgaaagagttaacccagatttgtttcttctgtacatttgattttgaaaaggcaattaacttctcttatctataaaatatccttaaagaatcttatgattcctcttaatcataccatttaaatttgtctgttttaaagaaaaatacaaatttagggcatgacattgcaaacagcctaagcaaccttgtctccatttaatctgttctcattagtggcaaataaataagaaacaccagtgtctatcagatgtcagcattatagctctaaaatataaacttggtatttttaggtaaagcatgatgaatagcagaactaaaatatctaaaggggtgaaaccagtaaggcaagaatcatcaagaagtaaccaataggtaacagagaaaacataaagcagagttcctttgcagataaaattcttcattcattaatcaaagtttatcaaatgctgttaaatgacagacaatgtgctatgttttgtagacaatacgtacagactagtgagacaaaaacactaaaacggtaaatgactaaaaatagttttaggtgtctactcaaaaagtttataactataagaacatgcaatagagaactacaggcaatttggactataacattgaacgcagaaacttgtttgagaacaagtacaaagtgattctgctttctcctgcagaatgaggatgcacaattgctggtgctaggtttgacttaagaaccagataaagggaagtacagagattattatgttaagttcttatggaatgatgatacaagcaaaagtacaagacaacagtgttcaggaaagaattgattatcattcttaagtctgaaggaccctaaataaatagagagggcaattagcagccgagtgtccttggaggcaaaaaaaaaaaagaaggaaagaaaaaaataaatcttgccaaatattcacggtaaattaccctaatttgtgtagctacttcattcctaggaatttttgaatccttagctaaatgaaccagaaaaatgcagttttctcccgcttatctgaaatccaatggagtaaatgattgaaaagagattaggctgtagtgctaagcagaggtcaataatgattaccctatacttttttatgtaatttgaattttatctggagagaaatgaagaacatttgaatggctttaatgagaaagtatcatgatatcatctaaaatttatgtgagcaaggctgaagtgggaagaagtgattggaacacaatattagaaatgattaagcaatgaaaaatggtggccatgagcctcataattggtagtggttacagggtaagagaaaaggtggagaatcaaaaagatatttaagtggttgactagaaggacttaatgactggctaagagagaggaaaacacttaaggtttagtctgggcaaatggttaatgttggtgagtttaagaaatctggaagaccttagcaggtagaaggccatgagacatatttattttggtgcactgaagtggctatgtgagtggttatgttcaaacttcaattaaaaatataactaaaaaaagaaaattattaaagaataattgaatgattacactggagaaaataactgggagatcatgggcactgaatggtaactgcaatcataaaaatggatgaagtagtccagatggagcatggaccgttgacaagaaaaaccagaacagaaccccacagaacaaaagtgattgtggaatgtgaagaaaacaggaactgacaaagaaaacaggaatgccacagagttgggggtacgaatcaggagaatgatgccacctgttaacaaaagatattgtttctaaaaataatgatgtaaaagaatattattaatattattttaatatcttattagtgggtattatatttcattattcttatattattattgtattctatattactcttatattattatcatgtgtattgggatggctaaaataaaagtattggtgagactatggaagcacatttaatgtagtaggcactatactagaatcagttaaaacgcaatagaaggaagtggagaaagccattgtaggaacctccttcgagaattatttgtttcattttgggtgggttctactgataagtctacaattaattaatcttttctttgtctacatctaatctgctgtttatcccagtctgtatatttttcaccggacgcgttttggtttttatatctgggacttcaacttgggcctttttaaaacatattttgtgcctctgcttaacactttgaacatatatagttgttgcaataattattttaatatatttatcttccaattctgtttcagcactgggtattaattatgtaattgccacactaccctgaatgcacccaatgtattatctcattatgggtcatatgttcctgcctctttgcatgcctatcttgaattgtatgccagacattgtatattttatctcattcagtgctggatatttttctctcataataaatccacttgggctttgttctgggacatagtttagttacttggaaatggtttgatactttcaggtcctgatattaaaatttgctaggtaggatccatgcagtgctcatcaataagtccccactgctgaagcaagagtgttctgtgtattctaccccaaaccacctgaatctgaaggtttccagtgtggttgatgtgaacaggcactattctcagccctgtgttagctccagacactactatctctaatcctttgggtggcttgtttcaagctttaggtagttttctcaggtattcacactgatcggtactcaactggatccttgacatctctagagctttctctccgtatggccttcttctgcagcactctgtcctaggacatctatgcatcatggtctcttcaggacgtcaattcagggagccagttcagctttgcctgggatactcctccctgcaccactgtctacaaactctttaggcagtaacctatttcaggcaggaaggtaaatacagtgcctattacactattttagccaggatggctttcacatcagcatgtatttaaatattcctctacccccctgtaattctttaaattataagatttggggacttgcttaaatctaaattcaattatttttggggggaaaacattttataggacatagcgtgttttgacaatgcatatgagcttagtagacacagaatttgatcttatttctagctgtcttctggggctcattttataataaaaccattcatagttaacattgatgcacaggtatctttgattcaaaaaatatcccagatataaggtcaagttttcagtttcttaccaaaacggaaactatctttactttattggacaccatgggaggtaatgataaccgaggttgttaaatttttaacagaacagaaaaatactaattttcaatggcttctaggacttatttttcagcatattttatttctcacttacacaaataacagaaaacccaccagacaatgtcaaaaatataatcaaaattatattgtgattatcattcatctggttgaaattactgtttgtctctaatgaagcattcactattttaccatagaaacatccttactatgccactaccaactttagagaattcggtcacacccattaatggtcaagaccaccttcattatggctgtgaaagagtcgtggttttgtggggtttttttacaatatgagacaagggtaaatagatattagtttacctagcttgactcccacaggtctaaccacttactaattgataagtataatgcatttttatggacataaaatatatagtacagagtttcatatatatttccaaattcagtgaatttttgtaataatctatgacatatatgttcatgtcgttacgatgtattcatttatatgaccaaacttgggttacaaatcacattcagttttccttaattcagggaacttaatatccttttggtcaaataaaccacaggtccttctggatttttctcatagtacattatacacatacaatgcacaaataaaactttcaaattcctttcactcattttagaaagtaacaacttaaagagaattggagcataagacatttttctggccaggaaattttataacttcttctgagtatggcaaggagtatcaatgtttccattgttgctttaaagcattcatagttatgttcattagtaaaattgtcctcacaggttgctaaacagtatgaatccaaaggaaatgtatgtaacactgaaaattaaactgttcgagaaagccatgttcctatatatattgtgcctatttagtcttaactccagcattactttttttcaattgggtcaaacttaattacatcagcagccttgtgtgatcaatacaacaatatttttgtccttttccttaggtttcaacaaatttaataagccttgaaggttgctgagtttgccaactgcagtaaatgcaaagggtatatgttatactaaatccaaaatattttgagaatcacaagtaatataaagtgtgcatcattttcccccagtagaagcttgtttttaataaagaagaattttgaagtggctctgcctttattctgattgtgtataaatgttttatgtattatgtgttgatctgaagcaaagtgcacactgtacatcagccacattaatctctttgtatgtgaacaaagatgagcaaacaagtgggtgattgcaattgaaaataaaatataggaaaggtcaggatccaagagaaaaaaaaaaaaacaaaaacaaccaaccaacaaacaaaaagctgaaacctggcaatgatctgaagtatgatttaataatttcagactgaatgggattattgcaattttctagaacaatatgaataaagcaatcatattttaactccatatgctagaatgactagagttatactgataagaaatctaccataatgtatatcatcctgtagatattttattccatgatgatatgtattctagcctatgaggcataacaaaaaatggaaggccgagcacagtggcttatgtttgtaatcctggcattttgaaggctgaggaaggaggctcacttgagcccagcagttcaagaccaatctgggcagcaaagcaaaaccttgtctctataaaaaaaaataataaaaataaattagccaggtgcagtggtatgtacctgtaatctaagagattacagagaaaggctgagagtggtaggatcacttgagtccagtaggtgcaggctgcagtgagccatgatcacgccactgcccaatgtatgtgacactgaaggataaactgttggagaaagccatgctactaaatgtattgtacttacttagtcttaacttcagcattacatttttcaactgcgtcaaactcaatcacatcagcagcctcgtatgatcagtataacaatatatttgtccttttccctgggcttcaacaagtgtaataatttaaattaattaattattaaatgagatagggtgacagagtaacagaatgagacgaaagaaagagagagagaaagagagggagagagagagaaagaaagaaagaaagaaagaaagaaagaaagaaagaaagaaagaaagaaagaaagaaagaaagaaagaaagagaaagaaagaaagaaagagaaagaaagaaagaaagaaagaaagaaagaaagaaagaaagaaagaaagaaagaaagaaagaaagaaagaaaaggaaagaaagggaaagaagaaaagaaaaggagtactgacacataaacagaagactctccctaccgggagtcggatcaaccaatgttgttttgtttaatcatcattgttgcaatatagtatacacatcactaagtgtactagggacataactcaaaacgtcagaacaatgatcagaacatcagaacaatgatgctgagaaacatcataaagatgaattgagattgtgcaatactgttacgactaaccattttttttcctccaagaagttgtttacatttatattgtcattttgtagtttaataaaaatgtaaatgccactgtgagtgagaacaataaggaaaacaatgaaagaaaaaaaagaagataggttccccagagcacctgagcaacagatggcaaggaagatggcctgggtccaccgaggaggttttagcactcacattgctttgcatgggtgtttgaaagtggaaatcaccacctctattccagaggcaactgaataaagatgtattcttagttcaaacactgtaaaaatggcctaaaacagtaaatgggagtaaatatatatatatatatatatatatatatatgtgtgtgtgtgtgtatatatatacatatgtatatatatgtatgtgtatatatatatacttatgtgtgtgtatatatatatgcaacagtatattgggagaagtaacaatgataaaaatttcctttagctccaaggtagtcatattgtacttaagcactttatttcattttaaccctacttgtgcccatccttgatattttcacaatttacaaattggtaataagggtaatgtggtgatgcttaaattgaaaaaaaaaaaaaagaaacaaaacaaacaaacaacaacaaaaaaacagtgcttgtaagaagagggagaccttgaaaggtctgttcctttaaactagtgccgggtaaatgcaaaccctgttgtggatctgactactagatggcaaactgacttttaaactcatcttggaaacacagatgtaaagctggtgtatgagtattcttccgaaccaacagggtgtgtatgcacacacacagagactgattttaggaaattgactcacaggatcatgagggctggcagtctgaaatctgcagggtaggctaacaggctggagacccacagaagtgttgagtggcattcttgagtccaaaacagtatggaggcagtatttctttaggttggaactggttttgaataggttcctttattgtggaacctgtttaataatttagaggagttcccaggactattgcgtaaattgcactgggtggtacatgcacaggtgtattgtactggagattagccagagagagtactggtgtgtactgcagtggttctcagacctggctgcaactaggaccaatggcagagcttttaaaatgtaccaatgccagccccttttcatcagtcttatttaatttgaaagcttcccttgtgattctgatgtgcacccagagataaaaaccacttttatgggaagtagaggtgtctagaaataattaggagaagtatatcatctctcatatgtcaagatataaacttgagcattgctcaagttcacagatttactatatagtatcacattgtcttgagtatttgcccggagctaccagaaacattcctagatgtaggtggtacatcaacaaaacataattctttctctgacattgattttttacctaatatagagaacagtttgtcaaaggatcttttaagtgaaagtaaaattaatacgatgtaaaatccatgctattcaatggtatttcatatttaaaataatgtaatacaagaaaattctaacatctacaaatcagttaccttacattttctgaggggaaaaaacttgtcactgcttttacgatatcagcgtcactgaatgaacttcattgtatacatttattacatgcctactgtgagctctgcctttccttagacagtgggggtataatgattacctctagaatacctgccctctggagctcatcattaatggggagccagccaatacgaaaatatgcacagagattactatttatatcatttatttcctaattcggtgaactacaaacatggatgaagtgatgaaaatcaacctgaaaaataagtcacatatcaaaactgaaaatcaaagtatactagagacagcttaattaacataaataaaacctatcaataatctatcagatatctactttggcctaacttttatgttaaaattcatagatcatatagagataattcattttatttaaggagtttaatatctaattggaggtagcagaaatattatgtgatgatccacaataaataaataataataatggttacatttgttaatcaattactacatattaaacactttcagcgcctacatccgctgactcacttaatttttataaaaacatatgaagtggtaactaccattttgccgatgaggaaatgtgtaaaatttgtaagggaattgctcaagttatacagctaatccctggtcaaattagaataaaaatagaagataagaaaaattggaatggagaagaaggactcaagagaaacgtctggcatcgaaacgctgacttgaaaatcactcacatagagatgaccatggaagatacaggaaggaactgaaatcacctaggaaagaatataacggggaaaaaagaaaacagttcccattctccccagaccctttttccactcttattctccctacttctttctagcgtctcccactatgggcaatctttgtcaagtgtattacccaaaacacagcacacctatttatatctgccaagagagaaaatagtcttttttcagagatgtgctctttttccctttcttgcccatactgaatgctccctgatctatccactgggagcctttcaggctgctctatctactggctctcaggacatatttcacatcacccttgttttgctcaagtttagttatttataggcgtatctgtcattcccagggattgagtacaccctcaaggagagttcctcaattataggtattaatttatgagttattcaataaaagaatgaatctctagctagggcaatgccccagtttgaaacaaacaaaaatccaagcaaataaaatgaaatcaaaaaccaaaacaggaaaagaaaaaaggcaggctgaggctagttcagtaagactgtgttcctggcagcaagattggagcagagacagagttgctgtacactcactcccatgagaggaaaaggaaacaggaggaaaagaaaagcctgatcttggcctgacttttttttttttttttttttaactagggcattgccctggttggagatttattcttttaatgattaatttgagaccaaaatatctacaaaatgaatattttataaaccttcactctctacaggtttaattatatattttaatgtcatgggatggatgttagccatattttatcactgttagttaaaccatatttaagttccagtaagagaatggcagaaataagcaggatattttaaactccaattgtctctcagacatgaacaaagctatcagaaaaagagcaacaagtttgactaagaattaaaagtgaggctgggcgtggtggttcacgcctgtaatcccagcacattgggaggtcaaggcaggcggatcatgaggtcaggagatcgagatcatcctcgctgacagggtgaaaccccgtctctactaaaaatacaaaaaaaatagccggaagtggaggcgggcacctgtagtcccagctactcccggaggctgaggcaggagaactgcttgaacctgggaggtggagcttacagtaagccgagatcgcgccactgcactccagcctgggcgatagagccagactccgtctcaaaaaaaaaaaaaaaaaaaaaaaaagaattaaaactggtctgccaggacttccttccatccacccgatggtcgtttcttaactgagagaatcatatcctcaaagaataaatgtggatatttgtgaattgtcagaaatgtgttagtaaacaagcagtttctcaagagcaggggggaaaagttagtgacagaaatatgttcaaacagctttattcctaggaatgtgcttcctcagagaacactaaaatcattcctagaaagttgcccaacttttacaactcagataagtctgcctagtgacttttcgttgtcgttgttgttagggcattagatcacaagaaggaaagtagaaaatggaatttagaacactttgatttcttttcaatcatagtttaagctaggattggaattttgagctgaaagctaattcctgagtagcattaaatttcctacctccttgcagggaaaggccacaatattcttaaattttaacttgtgggcgaaaaattgcaaagctaaaatgggttttgaggtctgtttcctgctgtgaaacatagattatagaacttactttgattctaaaatagaaatacatttttttatctaccataatgtaattaaagcaaatgtttatctgaacagtctaaataaagcattttgggttattgttaattgttatcctctgctacagattttgtctaaggtttagtctttagtgataacataataaaacacctgctttaaaaaatatttgaatttcatttgagatttataggtggtattcaagccaattaatgtactaacaaattaacagggttttttacttgctcaaatttaagaaaaacattctaccctgaactatatctccagctttaaagcaagagaagaatcataatacttatctcttattttcacacactgtcacctaattaattcttgaaaagcttggggaattgtgctttgatcctgtttttaagttatcaaaattagctttatgttcatcaactatgggctgttaaaacatcaactgtcatagtgaaaaaaaagtgttttttttaaaagaagcatctgataaattggaatcaaattaacgttttaagctgtcattttaggaaacaaaaaatcaagaaacaatgaaacagaaaaaatattaggtggagctacagatctacaagtattgaaatccaaggacagaagaagagtggcttatggatgatacaatagagaaaaggaaacaaaatacagaggcaacaggtagcttgaaagaaactaacacctgtattgaaaatttacatttccctggttttgccatatttaggtattaaaatatatttatagctttttgtgcgttaacttgcaacaatctgctttatgattattttccatatttttaagcaaattgttgaaaaatatttatgtatgtatatatgtatgcatatatctgatctgagcaataactaataatttttatagaaatacatttctaattttttctaaacattgctgtttcccttgccagtatgttagaattgttttcattacaatctgtaaggatatgcttcattgtttatattgctattgaatattattgaatattgctcagttttatataattattttccattaaggaaatttaacttgtgttctatttttccccttaaaattaatgctgtgaatgttatcatccctataaagttaaatattttcaagatttccacttctacttaaggggttttcatttaactatttaattttcaagaatagtatgcatatattttacatctcagctgtttattatattgccacaaccattatctcccaaattgttaattttcattttctcaaaattttaataatgttacttacggtttttagtatttgtgccatacttagaaaagccaatatataaaattaaatattaaatttaatattctaattattacactaaagcagtatgtattcatctttcctcctggtgtttcatggatttgttttttccactttttaaaaatattgtaattgcttttttacctagaaaatattatggcttaaaacatcagatatgaatctaattttttctcttttctctaaatagttaagtatttggtagatgcagtgtctcatgcctgtaatcccagaactttgggaggctgaggcaagcagatctcttgaggtcaggagttcgagaccagcctggccaacatggtgaaacactgtccctactaaaaatacaaaaattagccaggtgaggtggtttggcctatagtctcagctactcggaggctgaggcagaatctcgtgaacccaggaggcagagattgctgtgagtcgagatggtgccactgcactccagcctgggtgacagagtgagaatccctctcaaaaaagaaaaaaaaaaaggtcaagtatttgtccctacccatttattaaatagttcattattagcttgataaatgaacagaaatccatatattcttaaattcttccttctatttattttaagtaatttattatcatgatagtttgattagtatactttgataacagtttttttaaaattgcctttagtttttagggaggtgttaagttcatagcaattccatgcagaaggcttttatgcatagcctcttttactgtcaacatctctttgttgagtggtgcatttgttatcattgataaacctacagtgacacgtcaaatgcacccaacgtgcacggtttacattagagttgactcttgctgttgtacattttatgggtttgggcaaatgtataacaacatgcattcacaatcagactatcatacaaagttgttttcactgtcctaaaaaccctctgtgctgcaccagctcatccctcactgttccctaaactctgattttttttttttttactatttccatagatttgccttttccagaatgtcatatggaagtttggaatcttagaatatgtagctttccaaataggcttctttcactttgtaatatgtatttaagtttcctccatgtccttttatgtcttgatggctaatttgtttttaatgctgaataatattctgttatatggatataccacagtgtgtttgtccattcacctactaaacgatatattggttgtttccaagttttggtagttatgaataatgctgcttaaacatctgtactgattttagtgtgaatatatgttttcaactcaacaatatgttttaatagctcatactgttactctttttcccctaaagtttcttgactaaatttatagattcacatatacaaagtttaattttactttaatgagtataaaagttgtgctcttttagtttattagggcttattaaatagcctttagtttgtagaaagatttttattaagaaccaacattttcaagaatagaataatgtagaatgtgacaaaaatcatataatttatgaataagtcatatactgtataatcactacattaaccatgactggctaagtttacgcagggacagttcatgttcacattaattgttaaagagttttcattatattattaactgattaaaatttgtaatgtttttgatgtttttatctggaatatcattgccctccattactgccatggcctgatgaaaccacattctggttaaatccctgttggctagtctggtctcgaactcccaacctaaagtgatccacctgcctcggttgggtagttagtttgtgaacacaggaaaacagattattttttccaaattgaataactgaatattatagcggaagctattgatgttctaaacaaggtctctttgcccacgcccaccttgccatttacttgcaactgtgagatacagtttccccaagttcacaacttctacttaaatctttgcctctccccttatatgcaggactatttttgctgtaacctggggatcttgcccatttcaaatgagccaaactaaagttagatgtgtttatgccctgggaaaagtgaaaggtgactcacggccaatatggaaggaggatggtggttttatgcccagtttccccatcgtctggtgagatattctgaagcaggctacaatagggtttctcagagtgttctcagttcatttgaattccagattttcatagtggtaacttgctcgttagtacaacctactgtttgtctccattctcttactttccctctctctttgtgctttctgagatcatctctgaaataaattaactatagccaagtaattttttaatctctgcttttaaaggaacctcatctaaggcatgtatctattaaatttgcttatatcccatttaaattaaatatttttttcagatttctctacagtgccaattatgctttcaacttaatcaggaacatgttgagaataataagtttttccattatgattatgtttcttcacatttctcctagtttttaatttcaattttcattttatgtatgttaatgctatgctatttggaagagagttcttcagaatcatagttttgaattagcttttttttttttttttttttttgaatggctaccagaatcctgactctaataataggtagaatccaacatatacatttgaaaaggagaaaaaacacatgaacttttttttgttgtttgttttgagacggagtctcgctctgtcgcccaggctggagtgcagtggcgcggtctgcgctaactgcaagctccacctaccgggttcacgccattctcctgcctcatcctccctagtagctgtgactacaggcgcccgccaccacgcccggctaattttttgtgtttttagtagagacggggtttcaccgtgttagccaggatggcctccatctcctgacctcgtgatccacccgactcggcctcccaaagtgctgggattacaggcgtgagccacgaaaaccttccttgaaaatcaccaagttttctttattaaaaggtaattttattgttctgtgatggataaaattatcttgaaaaatactcaatgtcagatgtacttttatgggattttgtttttatacatgtaccctgctaataattttgcaaaaacatgatcttacaacattagagtggaatgtcctaattcagatgaatagaatataaatagtgaaacacaaatttggaaagtcctgagttatacaaatggaaaacaaacttaacagttgaggactgtttactttctctaatattaacgttgtggcagaataaactctgtgttaattcaggtttgtggaattgttgcaatgcattgttttctgaccatctaagaaagtgtaattttgacctactacagctatagctttcttttttatgcactctcttgaagaataaatgcaaaagctcaaaagataacaacataaatagggtatataaaaaaaaaaagaaaaccacctaaatcattctttttcttctttaacaaaaagaccacaagccagtgcaatctcagcaataagaattttaccttgaaggaaaagttggagtcatggaacactgctgctactttaaagtatctaatgtaaccattaaaacaactacatggaagaagtactttacagattagaacaccttgaaacagacagttgtgatatatttcataaattatcacaactgaaacaagttgcgacagtattcacatagaacagcttttttctctcctgagtaaactgtaatcctgtagtgaaaataacccctattggtgatggatctaaaaataggtctcccattatgcagcaaaatttttgattaataattccatgtccactaatctgcctccaatagcattaaggaaaatttggtatgctttttctctaatagattacaaaattttcacttgttgaacacttttaaaagtcaaacaataaagctaatatttattaagaagtcactgcatactagacaatttttatttatgcattacctttcttatttttgacaactatcttgcatgttagatataattgttaaacctatttaagtaataaccaaaatcaaggcttgggaaaggtgtttgtaaactaaatcactctaatggtcagcaagtggaaaactaagatatgtaacccagcctacttggcatgcaagaccatgccacttcccaccatataatagtatattcatgttgcgttgaaggttaaaaaagtgaatattaccaattttctacattaacaaaattcaagatcagatgtgtgtgcattaactatgaaattgggtaaaaataagtaaaaactataagaaatatataggaagtataaggagcatccagacagaagagaaatagctggtatttcaggaggtcagagatcttactacagtacattacactgaatggaaggagtactgacacactgagcagaaagtagcatcattttaataacaaaaaaacttcataaatacaaatttatatttttgaatcattaaactctaaaattagcttcagggagaaaaaataaaatcttagtaattttctgaagtatgtatatttggcaggatgccaacttctaaagtttttagatgagttttcctgagttagctaatagggagtttcacaggtgagaatctgtctccatctctgactttgcatactccagcatggcctcagatattatgtaattctcaaaatataagttattgtattccacttaatttaaataatatttacttataccatttaaaggaatgttaagtatcaaaaggaaaacaatgagaagatgtctccctttcaaatcggctgggaagagttatgcctgacaatttgctgcctctcaattgcagctgttaggctcaagtcaggatcagaagacttaagtccaaataagattgttggaacacatatgtttttctttttttgtataataatcacatatgttagtattagcaaattctgtaaattctgccttcaaaatatactctctaccatgaataagccctgtcgattctatcttcaaaatactctctccaaatttccaaagagcttgcttacttgagtttttgggtgtctgctcaaaatatcacctttacaaaggggtaattactggccatctaactaaaattagtaccttcacaacactcgtcttcgcccattttgtgttgctataaaggaaggtgcagggagggatgtgtacagagatcacatggcaagacagaaagcaagagaaagaggggagggaggtaccaggctctttttaacaatcaaatctgggggaactaattgagtgaaagctcacccgaaggaagggcattaatttactcatgagggatccactctgacccaaacacctccctttatgccccatcttcaacataggggaccaagtttccacactaggttgggaaaagacaaacatccaaaccatagcaacactacattctaatctcttacctgctttttatttctaactgttattatttatcaaaacttgcaacaatattataacagataagatgcccaattattaaggtatcacattatttgaggaaaacatttttagatgtacctgtattgttaaaaatgtatacaggttaagcatacctaaactaaaaatccaaaatgtgaaactttttgagtcctggtatgatgccataagtggaaaatcctacacctgaccttgtaaaataggttgcagttaaaactttgttccataagcaaattctttacaatattgtacacaattactttcaggctgtgtataaaaggtgtaagtgaaggataaatgaatttcgtgtttaaacttgggtctcatcaccaagatatctcattatgtatatgcaaatatgccaaattaaaaaagaaaatcaaaattcaaaacactttggtcccaagccttttggataagtgatacacaacctgttctgaaataatatggtcccaaacaatcacaaagcagtagcttcctaacttatctctatccacttcccttctctttgaaaatcataattttagccagcccttattggagaacagaattaggcaaactggcaatcaactgccagttgcactatatctgaataacagtcatctcaggtgaatatttctgggttttacttcattcgacagttatgtattcaattatttgttggctttaatcccacactacaatgtaggctccatgaggacaagaactttgcttggttcactgcttaatatccagtgcaataacagtagaggctcaataagtacatgctaaaacaattactggattgatttgattgctatggaatatgctagggtgtgacttatgtttctaagaggacttcagagggccccgggcactttccctacccacaaaatgcttgtagattttagaaaagttgcctttgagaatagaaaaagaggcctcttagtcatggacagagtttaaaaaagcatctgaagtatgagacaaagcagcagtcaaatgagtcatttctagaatagcatctctcattccatcatcatgcagtgagcttccaacactagattcatgttcttctgataatgtcatttttaaattgacaatgattggaaatattccaagaatattctcttttacttaggaagttaaaatggaatggaaaaaaatgtcccaaatgttgccatgcatataaaatataatctacccaaagaaagagcaaaggactgatatttgaccactgcgtacttggaaagtacagttccaaaagaaacaatgaaaaaacatatagaaaaaaatcaggtggattgatatattgtttggctttggaaaattttaaacatgaaaaaataataatcccaccatacttgatatgcttaatgcttacttatcaaaccaatgttaaaatctgtaggattttccttccaagcactcttgcattcaaaatataactaaagagcattgcaattacatttactcaaagaaatagattctgtagattgtccctgattatcttctttcctcacttattgtgctgcctctcccctcgtgcctttacagactaagaaaaaaatccagttttatttcatatttctgaccttcatgatggtgttggccccataatatgatacttcttcgacaaataaaacatgtgaagtgccaaggttatgttatattttaatacagtaaaatgtaagcaataataccttaattatttgtgtgtactagtatattacccactgttggaataggaaatcagacttagctagtacagatacccctacctcctccccaacagatactaaacataagaatataatcatcattcatttttgggcatgaatatctttttttcctcctagataggagaaaagcatttggttgtaaaagagacatgaaggacagaagttgagtatggtatggcttgaatgtatggtatggcttcctttcagtgtgactcctcaggctgggtttgagcaactgtggttaaataatgaaggacagaactcaagcatactatttgcatatgagacagcataagggtaaggacaaggatttgtgaatcagaagtcaaaagactgttcaaaagtgaattattagattctggtcataagcaggaccgcttcagtgacttaaggatatagcctggcaaggatggaaaatggtcattctttctatgcctgtccagaattcattggtagcttctatctctgtggattataaattttgggtgcatggtagaaacaaagtgcttggcacaaacacttgtgatttcgcaagagatgccatcatttagtgttcttaatgtggcttttttgatctcatatgttaattagaatgtaatagctatgagggtaagtgatgtgcctattgtgtttaccactctagtcaggtgcctagcaccatgctcaggccagaatatctccttgataaatatcagtaaacaaatgaatgaagtgcaagtagaaaatactacttaagtgctcttcctggcctgactggtactatgtactaaggcactaattaagaaacataaagtggctgaatagataaaacacacaagaccaaactatatgctatctacaagaaatttacttcacctgtaaggacacaaatagactgaaattgacagatggaaaaaatattccatacaaatggaaaccaaaaagtagcaggagtaactatacttatatcaaataaaatggactttaagtaaaaaaactataaaaagatggaaaagaccacaggtcaatagagaaagaggaaataataaatgtaaaaatacatgtatccaatattgatgcacctaaatacatgaagcaaatgttaatagaccaaatggagagctagaatgcaatgcagtgatagtatgagacttcagcatcccactgttctgcaatggattgatcattcacacagaaactcaacaaagaaatatagaatttaaaatggactctagactaaatggacccaacagatatttaaaaaacattccatccaacatctgcaggatacgtgaaaattaaccagcataacttgaaatactgatgggtcaatcaataaattttaaaataaatttaaaaattcctgagatgaatgaaaatggaaacacaatataccaaaacctataatgaaacagagtataagcagttctaaaaaaagaagtttacagtaataaacatctacatgaaagaagtagaaagatttcaactaaaggagctaatgttgtacctcaagaacctagaaaaacaacaacaaaccaaacacaaaattaggagaaggaaataaataataaagattagagaagaaaaaaactaaatagataagaaaaatataaaaaacagtgagataaagagttgggcttttaagagctaaaaagttgacaaatctttaacaacattaagaaaaaagagacaagactcaaataaattcaggcgcgaaaaaggagatgttacaactgatatcacagaattaaaaagatcattaaataatattattaacaaccatacaccaacaaattggaaaacctaggggatatggacaaattcttagacacatgtaatctaccaaaattgaatcacaaagataaaaaaaaaaaaaaactttaacaaactaataatgattaatgagattaaatcagtaacaaagagtctcccataagagaaaagtccaggatctgatgaagatcctggactcagttctactaaacattcaaggaagaaaaaataccaattattctaaaactattcaaaaatattagagtggaaagaattcttccaaacccattatatgaggtcagcattactctgctaccaaaatcagatagggatgcaacataaaaagataacttcagacaaataaacctgatgaacatgcatgtaaaattcctcaacaaaatccaagccaactaaatccaagagaacatcaaaaaggtcattcagtaatatcaggtggggtttatcccagcaatgcaaagatgattcaacatatgcaaatcaataaacatgatatattatatcaacagagtgaaggacaaaaaccatatgattatctcaatagaagaagaaaaagcatttgataaaaatcaacatcccttatgataacatctataacatccctttataataaatattcccaactaattatttataggaggaacatatctcagcacaataaaggctgcacatgacaaacccacaactaacattataccgaatgaggaaatgttaaaagttttacttctgaaatctagactaagccaatgatgactattttcaccacttttcttcaacatagtactagatgtcatagcctgagcaattaggcaaaagaaataagtaaattggaaagaagaaagtcaaattatccctctttgcagacagcatgatctttatatgtatagaataccctacagattccaccaaaaaaagggtcaagactaataaatgaattcagtaaagttacaggatacaaactcaccatacaataattagtagcatttatatatgccagtaacaaactacatgacaaagaaatcaagagattaatctcatttacaatagctgcaaaagacctgtaagaataaatttaacagctttgttctttttgcttaggattgccttggttattcaggctcttttttggttccatatgaattttttaatagtttcttccagtctgtgaagaatgtcaatggtagtttaatgagaaaaacattgaatctataaattgctttgggtagtatgtcattgtaatgttatcgattttcctgcctatgatcatggaatgttttttgcttctgtttgtgtcatgtatgatttattttaccagagatttgcagttctacttgtagaacttatcagtgtaagaagctctgaggctgagatgatgaggttttctagatataggatcatgtcatctgcaaacaggaatagcttgacttcctcccttaatatttgaatgccttttatttctttctcttgcctgattgtgctggccagaactttcaacactttgtttaataggagtgatgacagagggcatctttttgttgagccagttttcaaggggaatgctcccagctcttccccatttagtaagatgttggtggtgagtctatcatatatatttttgttattttaaggtttgttctttcaatacctagttcatttagagttttttttatcatgaagtgatgctgaattttatcaaaagcctttcctgcatctatgagataaccatgtgtttgttttctatagctcagtttatatgatcaatcacatttattgatttgtgtatgttgaaccaaccttgcattcttgggatgaagcctatttaatcatggtggataagctttttgatgtgctgctggagtcagtttgctagtgttttgtcaaggatttttgcatcaatgttcatcaaagatattggcctgaagttttcttttttgttatctttgtatttctgtcaggatttggtataaggaggatgctggcctaatgtaatgagttagggaggaatctctccttttcaattttttggaatagcatcagtaggtatggtacaggatcttcttagtacacctggtagaattcagctgtgaatccatctggtcctgggcttttttaggttgataggctatttattactccctcaatttcagaactcattattggtctgatcagggatttgacttcttcctggttgagtcttaggtgtgtgtatgtgtacagaaatttatctattacttctagattttctattttatgtgcatagaagtgttcataatattctctgatggttgtttgtatttctgtggggtcattggtaatatcccccttatcatttctgattgtatttatttgaatcttttctgttttttactttattattctagctaatagtctattttactaatttttttcagaaaaacagcttctggattcattgatcttttcaatggtttttagtgtccctgtctccttcagttcagatctgattttggttatttcttgtcttttgctagctttgggatttgtttagtattggttctctagttcttttagttgcaatgttgggttgctgacttgatatctttctaactttttgatgtggttttttagtgctataaatttccctcttaacaatatcttaactgtgtcccagagattttggtatattgtgcctttcttctcattagtttcaaagaaattcttgatttctgcctgcatttcattatttactcaaaagtcattctagagcaggttattcaacttccatgtaattgtatagttttgagtaaatttcttagacttgagttttaatatgattcttttgtggtctgagagactgtttgttattattttagttcttttgcatttgctgaggagtgttttacttccgattatgttatcaattttagagtaagttccatatgccaatgagaagattgtatattctgttctttggggtggagagttctctatgtgtctatcaggtgcatttgatccagcactgagttcaggtcctgaatatctttgttaattttctgtctcagtgatctaatactgtcagtggggtgttaaatttccccactataattgtgtggtagtctatgtatctttgaaggtctttaagaacttgctttatgaatctgggtgctcttgtattaggtgcaaatatatttaggatagtaaatcttcttggtgaatctaaacctttaccattatgtaggcctttttggcttttttgatctttgatggtttaaagtctgttttgtcagacactaggattgcaacctctgcttttttctgttttctatttgcttggtagattttcctccatctctttattttgagactttttgtgtcattgcatgagagatgggtctcttgaagacagcatactaatgggtcttggttctttatccagattgccactctgtgtcttttaactgtggcatttagcccatccaggttagtattgttatgtgtggatttgatccattcatcatgatgttaggttgttatcttgcagacttgttttcatgattgctttatagtgtcactgatctctaaacttcagtgtttttgtagtggctgccaatgggctttcctttctgtatttagtgcttcctttaggagctcttacaaggcaggtctggtggtaacaaattccctcagcatttgcttgtttgaaaaggatcttatttttcctttgcatatgaagtttagtttggctgaatatgaagttctggattggaatttttttcctttaaaaacattgaatattggcccccaatctcttctagcttgtaggatttccactgagatgtccgctgttagtctgatgggcttccctttggaggtaacctggtctttctctctagctgaccttaacatttttttctttcatttcaatcttggagaatctgatgattatgtgtctttgaaatgatcttctcctggagtatcttactggggttctctgcgttttctgaatttgaatgttggcctttctagctaggttgggaaagttctcatggatgatagccttaaatatgttttccaacttggttccattcttcccatctctttcaggtgctgggatgattggctagccatatgcagagcaatgaaaatggacccctttcttacactgtatataaacattaactcaaggtggataaaagacttaaatgtaaaacccattcaggacataagcatgggcaaagatttcattataaagttgccaaaagcaattgttaacaaaagaaaaattgacaaatgatatctaattaaagagtttctgcacagcaaaagaaactgtcaacagaataaacagacaacctgaagaacagaagaaaatttttgcaaattatgcatcaaaggtctaatgtccataatctataagtaacttaaataaatttttacaaaaaaaaatccataaaaaagtgggcaaagtacataaacagactcttcaaaaggagatttacaagcagctaataattatatttagaaaagctcaacattactgtttattagagaaacacaaatgaaagccacaatgtgatgccatctaacgccagtcagaatggtcattaaaaataaaaaaataacagatgctagtgagattgtggagaaaaaggaatacacaaggaatacacttatacattgttggtgggagtgtaaattagttcagccattgtagaagacagtgtggcaattcctcaaagatctaaagactgaaatatcattcaacacagcaatcccattaccacatatatacccaaaggaatataaattatcctattataaagacacatactgtggtggtgtgtgtctgcaatcccagctactttggaggctaaggcaggagaatcacttgaacctgggaggcagagtttgcagtgagttgagatcatgccactgtagtacagcctgggtgaaagagtgagactccatctcaaaaaaaaaaaaaaaaagacacatggatacatgcatgcatatgatcactgcagaactattcacaatagcaaagacatgaaagcaacctaaatgtccatcaatgattgactggataaagatgtggtacaaatacaccatggaataatacgcatacataaaaatgaatgacatcgtgtcctttgcaggaacatggatggatctggaggccattatccttagcaaactaacacaggaacagaaaaccaaataccatatacaagtgggagctacatgatgagacacatggacactgagaggggaacaacacacgctggggccttctgaagagtggagggtaggagtagggagaggttcaggaaaaacaactaatgggtacaaagttaatacctggttagtaagataatctgtacaacaagcccccatgacacaattttacctatgttgcaaacctgcacttgtacccctgaacttaaagttaaaaaataaaaaaggataaaatttataaaagttgtctataaaaattataaaagatctctactattacaaaatccaaaacatatatgaaaatatggaagagaatacaaacaaatggaaagtcatcctatcttcatcctatgaagtggaagaattaatattgttaaaatgttcatactaccaaaagaaatatacaaattcaatgctatccctaacaaaataccaagacattattcataaaaatggaaaaataatcctaaaatatgtatggaaccatggaagaccccagatagccaaagcagccttgagcaaaaagaacaaagagacagcaaactacctgacttcaagaaacactatatagtcataataaacaagacagcaagttactggcataaaaacagacaccagagaaacagaatagggaacccagatataaattcttgcatttacagccaactgatttttgccaaaggcaccaagaacacacactggggtaagggcagtctctttaataaattgtgcttggaaaatgtgatggccacaggcaaaagaataaaactagacccctgtctcttaccatatacaaaaatcaattcgaaatgaataagagttaaatctaacacccaaaactctgaaactactagaaaaaaataacataggaaaacacttcatgatattgttctggggaaggatttttttgtcaagacctcaaaagaataggcaacaaaagcaaaaataggcaaatgggattttgtcaatccacaaagcctctgcccagcaaaggaaacaatcatcagaatgaaaagataatttaaagaatgggagaaaatgtttgcaaactatgtatctgacaaatgattcatgtttagaatgtataaggaccataactcaatagcaaaaaaatcctaataatcctgttgaaaactgggtgaaagatctgaatagatatttttcaacagaagatatgcaattagccaataagtgtcacatttatgactagtgtgccattattggaatgctaagtgtgtgggagttatttatatcccactgcttaaggtcatcaccaaggtctgattgcaaaaattcaaacaattgcaacctcaggcataaatgggttaaaaacatgctcatcatcacaaacatcaggaaagcacacatcaaatgagacattatttcaccttagttagaataactattaccaaaaagacaaaaaaataacaaatattggcaagaatgtggagaaaggaaagctcttgggaatgtaaactagtagagccattatggaaaacagtatggaggttcctcaaaaaattaagtatgtaactatcatatgatccacaaatcccactgctgtatatatatgccaaggatttaacacaggtatgtcaaggaggcgcctgcaatccacgtttagtatagccattatggaaaaaccatatggaggttcctcaaaaaattaaatatagaactaccatacaatccagtaattccactactaggcatttatccaaggaaactatatcagtatattgaagagatacttgcattccaatgtgatttatgataaacacttgctttccttttggggtctggaacttcgataaccatagtcagtcacatagactttacatccctacagaaccaatccgtaataaaaatcctgtatttctaggctaggtgagtttccctgtcaaaaaacactttgcacatgttgtcaaaacttactgatggatgaattaagtgtgtgctttgcaattctactgggagggcactcctggaaacttgtgcctaatgtgctctagttatgccccatttattcctttgctgcttctgttttgtattctttcactgtaataaattgtaactgtgaatacaatgacgaccatttcttgtgggttatattatcaaatcaccaaacgtgagggtgatcctggggataccttccataatagtttttaacctaaaaaataaatgaaggaaacaagaaataaaaagcaaatacagttactcaatagtgaaaagagtaatcaaccaaatatatctatttatatcattttgcaaattttttctatatgtatgagttgaagaattttttacatacaacatatgtattcttcaaatcagaaatgcttcaaaccatagccatagagaaaatataataatttatatgttgtacattttatattaataactaaaatatgtaggttagttttataaaaacacacaataaaattatgctttttttctggagacatgaattagtcttgtccatatagggtccttggaaagaggtaatgaacattgattcctttcattccagaatgctattaagatgaaactccctaggcttgtataggctcatagttttgctgaatcttttttattttattatgttttttagagattggagtctttctatgttgatcaggctcatctcaaactcctggcctcaagtcatcctcctgcctctgccttcagagtcactgagattacaagtgtgattcactgcacctggcttgttggagcttacagtcttattaatcaatgcttctaaacagaggcctcttctcactgctcatttccctttaagcagttttactatgtatcaagaaccaatattttatggggcagaaaatctccctacctactaaaacttcaacatttccacaaaatgcctgtacttcatgcttgacttaaatggaagatattttttcttttcctcataaaatagaagtttatttttaaatctatacaaattataatgacatttgggtacagtcatttacagtataaagacatcctgcttactgtcatttgaactatttatatgatatttataagccaaatgccttctacatttatgattacattgtttgaccaattattctgatatttatgggtcctcattattgcttcagtggaatacttattcacccacattcagagcattgaaacttagctgacagcttttatttacatcagctttgatatcttccactttcacccacttctggggcacaatctcataagcacaactgaggtttgtcatcatcagattctttcaacttcatttacagtcaccatttttctttcttaccatctccctgaattctaaaactctcgcacatccatttatcaagtatataacaacactcaaagaatccacccatttcctttgtgtgtttatttcctttccttccttcattctctacctctcatagcatctatctgaggcacatctatttaagcattttatagccagcagtcacaactttcttatttgtctcactgctgaatatactctgacaatagcctgcttaaatccagctgtcattccacttttgattactgctagagtgctactatgaaatttgatggcacaataacatgcaatatttaatttcagttggctacttattagattttcctataaatcaccaatagcatatatttgagtattgaaaacacacatgtatagcatctattgccagagcctacatgtcttttagagtctgttctgtgataatgactatacctatcacattgtaattttaattatgacacttgtcttcatgactgtatataattaagcctatactcaagttaaaaagaggtgaacataagattttaataaattcaaagtcataatcaataagatatttaattttagagagagaatggttagccttcagatttatttaaaatatagttaggttcagtcctgcaggaatgatcaaatctaatgtgcaatttattttatggtggctaatatcaaggtaaaggtaacatttccaaataaaacactgccaatttatgcttagattttaaatacattgtaattttctccaactcacaaacatcccacccaccattttaaaattggtattaagtgtatattttctttaaagtccacaatttaaaatgtggctttacacttttttaatcaaaacattttaattattttggctaaagtttattttaagatgttcttagacgtgaggctcattttctcaataaacaacaattgattactacttatgagagtgtctacagtgtagtgccttaaggaattatctaaacagaacagccgttagtacattagcagaacatagcctattatcaatcaatgcatagcaagttaggtagtcatgtcaaatttctttggcagaggaactgaactggagattttcattacaggcagaggaaaggtaattgattttgactttggacatttcaaataaatatcagatagttcatttctgttgatgtagctatttttcagaccattattattaattaagtattaaattacatatataccccaatttgaatttttttcctagaattatcagagccaattaggataaaagctgaaaaagaaacttagtttcatctgcttttggaataattttacataaagaagaacaacagttattgaatcatcatcaccaatttaaaattatcatgagaagtataaaacagttacctagaaattcaaagttgccaatggagaaatatttgcctcatactggtgagcatttacagcctaaaaagtttgtttttaagctaaaatgttatccagcaatgcattaagaaacacactagaataatattcagaaagtaaatgcaataaaaagtgttgtaatctttcttttaaagtgatatttcaagaagtttagtaccaccaaaaaaaaggtagtgttgtataagacattagcactaatatattcaaatcaaactgaatattatgatttaattataaaaaattattttccatatactcaactcaatataaatcaattatttaagagacatatacaacttgaaatacttaaaccaccatcacttttattttcttttaaaagaaaaataattacctacagaggcaagtttataaatttagttataagattaaaagtcaatgcattacctatctttcaacattctctaaaaattgtcatttaaatagtgattacagagttttatttctgccaatagtaaatgtgtcagaaatataacaggttagtcttaccataccagcagttagaaaattacctctgtcttaatataccataaaattttatttaaaagccattgagaaggaataaatatggaatcctattatttaatttttatattcactttttcagagaatatcttcactttaaaatatgtgtttttaaattttctaggcagtacttagcttcctaatgtaaaattcacttcccactgttaccccatgaataattctggtatggaaagctacctcagtaaatctctcatacatctcaagtaagaagtacttccatttgtatctgcttatccaagagagatgagtagttaacatcgagtattgctgtaagaattcctaaagctcatatttaaacacagacagcaaacacatggtcttctatttttctgccacctctaaagcatcaaaatattatactggcttgggtagtaaatattatgcaatgcattaggttattctggtatcaatttcaatatacacaaataatggctcaaacaagtaaacaattttaaaaaaccaacactttatgtgaaatgtggaaaattaatgactccccaatgtaaaagaaattaaagcaaaggaacttagaaagaagtgtccaagtttaaaaataaactaaaagtttaccgaaaactcaaaaattgtttttctacctaaagacctgcttttacccatgaagttttaactgttataaaacttgtccacccaaaacaaacagaaaaaaaaatttgaaaaataaacaaagcaacaatttacagacattggacaacaagcagcagaggactgtcatgcatgtaaaaagggaaataaacagaaagtgttctatataatcctagttttctgtcaggaggcaatttagcaactacaattcagaaagaaaacactaactgaatcaaaggttttgccacacttaggaggcagagatcagagttgagggacactaaggttcctagaatttgcaagacggagaaatgaagaagaggaagctataaagagacagagttccacaaagagcttcagacacacagccatgagtctatggttgagtaacaatctgcacacaaaactccatgagtctgggcaaggaacaattgataaagaaaattcaccatgaatgtataagctaaataattttattttctcacaaagtgctgcaaatcttttgagtatccactagccagtaaagtgacatcattgaatatatgcggattgtcctagggacctcagaagagccacatatttgtagtggagctacttagccctagagtaaaggctactctagactttactttagaaagctaaaaaacgtacattgaaaacaattaagttgatgtggataatatcagtctaacctatgtctaattctattgtctaggcaggcatgtgtggaagacagaaaaaaatatttaaataaatgacagctgagaaattaccacatttaatagaaagcataacacaatggttccaagaaggtcaataaagcttaaggaagataaacacaaataaaatcacgttaaagcatgtcataatgaagttgttataagccagataaaaagccaatttaaagccttcaaaatacatattacattcagaggaagaaagataagaacaattacaagaacaattattgatcctattctcaataatactacaatgtaagtattagtgaaactattttctaaaattatgtaaaatgtctggaaaattttctaagaccatatagcatatggaaaaatgtttgctcaaaagcctgctgaatttcattgagaatccttggcatttcagtcacaatctgcttcctttatccctctcttttagatctgttttggaagttctaccctgtgtattctattacaggaacgtgtggtcaagaagacagaggctcccttgacccccatctctcaatctatatctgatttcaccctgggtaggatagagtgccagtatttttcattccacctctagactcagttgcaaaagcttaattctcagcaatcctggtagaaaggactgggtctcacttctcccacccagcttgtccacgtaaggtgagattctacatcagtcacagcatgctgagaatattgtggctcctatttcccctgccccaccttgctcttcagatggaggtttcacgatggttggggaaagtcagaactgcagggactgccacctttacctagttagtggggagtaattccagaaaaatgagtctggcctctagcttttgtgcaatggcacaggagtttagacagggagagaggcagaccagaaaaatggacaaaactgcagcttagcctgagagggctgcttctatttagaacagaatttgaagagctccatgtgcaagattgttattttcaatcttacacatggagctcttcaaattctgttctaaatagaagaatttgtaaaagtcttggtggggaacaattaagaagaaatgtcagctccagaataaaagcaaatatggcagaacagcctgtttaatagaaaaaatgagggagacagctaagaataggtctcctgcaatcccattcaacttcagtgtttgagaaggctgtgcacaggcactaagctgcacctactcaagggcaatcagaacagaatgcatggagtgtacttgagaggattatgcaagccatacaaaaaaatcatcaatagagagcaaaagcctcactggtccgtgaagttttaaccctacttctgaccacaaactgattgaacaataagccattctgatggaggagtgactaccaggaatataggcttaaaaataaaataaaagcagtaattattggctgccttgaaaaatttgtgcatgagcaaaacttcaatgtctcagaaattttcacaagggaatctataagcttttagttctgggttgaccatacagcaaaaaaaaagaaaaaagaaaaaaaaattatctctcagagctgtaaaaacagccttttctcctcaaatcactctcacattcaaggcttaaaggcagaaatccaactggcaaaggggatttgggcacaatatttgacccataaatgtttatatcaatccagggactacttctagacaatagcccttggaatgatgcaagcatttattagtcaaagattggctaaaagaccgtaaaaagggtaacaaatacaaggaaggatgtcaggagctacacaacacagggtaaacagactttatggaattagtaccaccaggtcactaagaaagtaaacaaatagtcaagcaggtaacagtaaccctctggatcagtgagtagaggtgggatcagtctcaataatgactcaatgtaagacctaatattttctattttcaatgataataacagcaacaaaagtgtgacgagtgcacggggaaaaaatgcaggcaataggtatggcctttgaagaaattcaaacattaggttcagcagaaaaaacttcaaagcagatattatagatatgttcaaataattaaagtcaatgatgcttagagaagtaaaggaagacttgatagtaatgtcttacaaaatatatgctatcaataaagagaggaaaattataaaaaagagccaaatgaaaattttggagttaaaaatatacagcaactaaatgaaaaattcactagatgttgttatcagtaggtttgaggtggctgaagaaataatcagtaaagttgaggctaagagactatacaatctcttagattagagaataaatagaaataaacagagcttcagagaaatgcggtataccagtaagtgttgcaacatgatatgagtataactagaggagtacagggagggacagaaaaatattcgaagaaataaagactgaaaacttgccaaatttgggaaaaaatcttaacacatccaagaagcacaatgaacactaggtagaataaatgcacagacccacactcagatacactaaagtcatattgttaaaaaaaaaaaaagctaggtggggcatggtcgctcatgcctgtaaccccaatgctttgggaggacaaggtgggtggattgcttgagctcaagagttaaagaccagccagggtaacatggtgaaaacttgtcactacaaaatattagctgggtgtggtgtcatacacctgtagctactcaggaggctggagtgggacaattgattgagcccaggaggtcaaggctgcagtaagccatgatcataccactgaactccagcctgggtgaaagagaaaaaccttgtctcaaaaaaaaaaagggaaagaataaatagctaaattctaattgcatacatttgagccagaaggatgacatattcaaagtgctgaaaaaagaaatatgtgatcaaaaacttagtatctagcaaagctctttcaaaagatgaaggcaaaataaagacatccttatgtaaacaaaaatgaaataactggctggcagctgacctgccttataaaatatgttggaggaaattcttcagactgaaattaagtgattaagtgattctgagcagtcactcaaatccaaataagaagcaaagagtcatggaaaagttaattatttatagaattacaaaatagagtgtagtggcacatatatttttccctccttttctcagctaatttaggtaattgcataaatctatattttctagtttcttcatgattttcatatttgacaagaatgtatgttacatcattagaatccattttaatttttaaggcttgttttatggtctaacacatagtctgttctggagaatagtctacatacattacatgttgagatgaaagtataatctgctgttggataaaatgttctacaaatgtctgtttggtctagtttgtttataatgttgctccagtcttcattttcttgtcaatcttcagcataattctacccattaataaaagtagggtatgaagattttcaactactattattgaataattgtttctttattttatagtctactttgatattcatatagccactttagctcctttataattttttgttttggtttatatttttcattcctttaactttaaacttgtgcatctctgagtctagaatgtgtcccctgtaaaccacaagtaattgaatcaactcacttttgattggattgtttaatatattcatttgtaatattattatttttgtggttgaatttacatctgccattttgcttcttttattctttttgaatttttcctttttctgtcttttgtttatttcctattttattgttaagaggatattttctaaagttaaattttattccatttaataacttttatttatatactggttattttcctagtggttgctctagattttgcaacatgcatcccatcaggatctacctcagatttacagtgattgaagtccactgaaattaaaatctttactcctggataactctactccattcctctctcttttgatgctagtgagatatatatgtagcataaacttttataagtttgttatgattatttcttcatataatcttatgtgcatacatttttgaaaaacaaaaccaaagttggagaactcatacttcctaactgtaagacttactacaatgttacagtactaaacaaagtgatgtactgtcatgagtatagacacacagattaatggaatggaattataaatttataaataagccttagtatttatggtaaattaattgttgacaagggtgtcaaaaatagcttttcaacaaatagtgctagtacaaccggatatgcacatgcaataaaatgacattggacccctatcaaaccatacataaaagttagctcaaatggattatatacctaaatatgtatgagttaaaaccacaaaactcttacaggaaaaaataggtgtatgtcttcatggccttggattagccaatgatttcttaaatataaaaccaaaattacaatcaatggaataaaatatacataaacatatataaactctatttcatgaaaattaaaaacccttatgctacaaatattaacattaactaagtcaaaaggaaaaatacagaatggaaaaaaatttgaatgccttaaatctgataagggacttctacccagaatttacaaagaattatcagaactcaataataaaaagacatataatccaattaaaaatgggaaagaggtttgaatagacatttcaacaaagaccatatacaatggccaaaagcagagcaaagattaatgaatagggaaatgaaactcaagacaatgctgaaaaatagcttcatatccactagcatggttgtattcaaaagcacataataacttgtgtgctccatgtagagaaattagaatattcatgccttattggtgggaatgtaaaagattacaggttctttaagaaacaaatttttcactttctcaaaattttcaacatatgacccatgaatttcacttctacttatatattaaagagaagtgaaaacacactcccacacaaaagctgtatacaaatgttcaaagcagcattattcatgataaccaaagaatggaaacaatccatgtgcctttcaactgatgaatggataaataaagtgttgactaaccatataatggaatcttatttgttaataaaaaatgaataattacaaatgactatatcataggattctatttttataaaatgtttacaataggcaaatctataagacagaaagtagactggtggtttcttacaggtaggggtagggtgaggttcaaagggatgtgaagtggctgcaaatgggctgaatattttggggaggaggaaaaataattttagatttgctttcagtgatgattgcacacacgtgaacttactaaaaactttggcttgtacattttaaatgggtgaattgtatatgagttatatctcaataaaacttaaagacataaatcacagatttctcagcagaaatcccatcaaccagaagatcatgaaaaaaaaattcaaagaaatgtgatccaaaaaataaataagcacaaatgcgtgtgcgtgcgcgtgcacacacacagacatagacacaggcctggcttacttttttataaataataacacagctttgatgaatttatcattagtaatgataatatgatttcataaaatttcagccattaaaatgtttatttccttgtaaaacatttttatattgaaaataaaatatttttaaaactaaatttaacacacacacagaattagacaattaagtaactacactgtagaaaataggaaccacgtttttaatggccagagaaagactttacaaataatcaagtgaggagggaaatacaaaccttgtgctgatgaatttaattagagatattagtttgaattcattttaattttagcatataagaatagctaggaaaatatagacagaagtatatacatgggtatacacatatatgtctatacatactatatatgggcttatatatggtaatcatacaatggaaaactgatatgaaaaagccaaatgtgaaagacgaataatcttaatatattgttttaaactaatgtttcaattattattgactgctttcataattggctaggttttgaaaaggtcaggtaaataaaattaaacaatatctgcataactttccattgattttagtaagctaatttgttttatgagtctccacaaaataggcaaaatatgtagtttagctggatttatttaaccacagaatacttttggggacaatttttaatgggaaagtgttctgtagaaaatgacaggctagaacaaatgaatttaaataaaatattaaatggaaaaaattaaaggaggtaataaaatatcagaatacatcattttacatgtaattttttctttgagacagcatcttgctttgtcacccaggctgaagtacagtgctgcaatcatcactggctgtagcccagacctccaggtctcaagagattctcccacctcagcctcctgagtagctaggactacaggtgcacaccatgacgcctggctgatttttttttttaattttttgtagagacaaggtctcactatgttgtccatgcttgaactcttgagcataagcaatcctcttgccttggcctcacaaagtgttaggattacaagcatcagccaccgcgtctggctgaaaagaggtactttttaaaaacctttgatttcgagttggcttggcttacttttctgtaagtaataacacagctttgatgacttgatcattaataatgataatacaatttcataaaatttcagccattaaaatgtttatttccttgggaaaacatttttatattgaaaataaaatatttttaaaactaaaattaacagcatttaaatcaaaagagcaaaccaatagaagatataaaacagtgtttctgaatgctcaaccaaagttatttctgggaaaagacttagtttgagtgttctgaaacccattttgtaagaatctttctctctgaatgttgcctcgtctttcacactacttgaattcatttatttcacataaactcacatcacatatctggcaagatgattctatctacacatagataaatgtaagtggaaagatgtgaaatggaaaagtgaactctcttcaaattctatcacgttcaaaatgtataagattagctggcaatttctagaatcttgtgatttaaattcttttacctacggatatgtataaatctgttgggtttagcctatatctactcttaagtgcagcttcattaatgtttatgcttttgaagaataaaatggattccaaagattccatgttccttattcaaatgtaaaatgactgggcaattgaagaatgcaattatctccaccaaaatgtttctaaacatctttaagaaggttgagttattatattttaaagtcgaaattacatttaagtttcgttctgtgtctcaatgactcattgcagatttataattgatgaaaatgtctacaaaggcatggggtatttgattctgcatgatacttgaacctagatagcttctgataaagtgaaaagacttctgcagaatataaaattagtgtgcttgtaaaatgacttgaaattccacagtatagctgcacccaacaaaagcaaatcaagcatccacattttataaagtgtgttcacttatttcaaataaaaaactgttcaagtgacctacttttcatcaagacactttaaaatgagaaatgaagcacataaacatggcaccatgtgtctgatatctcctgaagtgacaaatgaattctgattacacataacctcattgttcaatactcaattgtatctttgaacaatgaaaactgagtcatactatgccaagtatgaaatatgctcagtactatataagtagcagctatagtagatgattgctatcttcataatgaacctgcacctgaaccttaaagcagaaactgacagtgacctttgtgatagacaggattttaaaatagcctcccaaactcctatcccttgctatgcatgctacataatggcctcatgagtttggataggctatcttgaagaccccatacagaacgggatgcagatgttacagatagaaatcagagcaattcaaagctgcaacaaataccatcctgttgactttaaaggagtaaactgccatgtttgctcagggccagatggcagggaatggtaggtatcctctaggagttgaaaaattatgtctagttgacagctagcaagacattgagggctttggtcactgttttgatgcctgtcaactggagaaaatgtttgacttttccaaacaattggtgagattggcagagtactgaattttcacataattttcatatgcatccatagcaatcttgatttcttcttggtgagacactgagcaggggaaatagcttatccaaacccagactcctgacctacacaaatgaagcaataataactacatgttttaagttgctaaatttgtggtaatttgacagtaacagaaaactaatacaattttcatatgatctttcataggatttgagaaaaatacatttgaatacaaaaacaaaatgctatcaaccatcctaaaataattgtaaaggagcaatttaaactatcttctttttatagactctccctacacacacacacacacacacacacacacacacacacacacacacacacaaataatgttgcatctctcaccatgtctcattattctaggtttcttattcttcattctaaaaatgaaatcttaatcagttttcttagatgtctttgtacattcttttaaaattcttatacaatttttttaattgtcaagatcaaaccctgactcagctaaaatagatgaaaggttatccaattaaacatacatcccctagtatttgtaggaaagtagcctaaaaaaaattccatgttgacatgtaatttgtatgtctgttcaatttgcaatgttttaaatagcaagttaaaataaaactcttctaagtttaacttgaagtacaatattaaaatgtatgatttaaattaataaaattatatttatttggtaacagttccttttagaataaaagatttcaaatatcatataaaataggctaagtaaatgtgaaagatgtttttgaaatctacttaatgcatcgaaataattaggtaatttttattgtgtgaatataaaaatgcacaccttttgtaaattatgagatacttgctttccatcaggtgcaaaaagagtttacaaaatgtaatatctaagataaatatgttagctaaaaagagtcatatgaaattatgaattttataatagtcagaaaagaaattgttaatggtgattatgggaacagtatcttaaagttgaatatagtttaatacatcagataagaacagcagaattctggtaaatgactaaggaaacaggtatcttaaagaatgtattaggatgtatgatattttaaaatttcctatagttgcaccaattactttaggataaatttgaccaaagtattgaaattcaaaagaagatttaaatatgaaggactaagtcagttgaagcaattacatgaaacagtatattatcttattttttagatttaaattgattagcatatttaacttttacatgaggcagtcagagggctaaagagattgtcagaatacaagaaagttttacaaatttcctattgagtgttgaagtaattataaaattctctggagcaacatttctctacctgtaatatgaatatgtgtctcccaggaatcttattaaaatgaaaatactaattcagtgggactagaacagagacccaaattcttcagttctaactagctcccaagtgatgacaatgctgctggtctattgatctcacatagaatagtgagaccctgatcatccatatggaattatggacagaaatctgtgtctacactacctaatatttctgacatctttgggcaacccatgtgaacttaggtaaaaggtgaaatatttgagtgcatataaagttagaatgctgtctgtagtaaattttgcttctatgacttttaacccaaatacatataatacatatttgttaatatttcacaaatatatattgattagttgactctttatatgacacagtgcctcaatgcatttcaaagtgacattgatcttgtgatcaaaattaacaacagttggacattttaatgggttgaagtccctaaggagatatgttaaagtcctaatctttaatacctgcagatgtgaccttatttgaaaacaggatctttgcagatgtggtcaagttaagatgaggtcattagagtgggccctgatcaaatataacttctgtccttttaagaagagaagacagagacacacaaggaaaagactgccacataatggcagaggcagggattgcaatgatacatctgcaagccagggaacactcctggggtacctgaagctgagagaggaaaggagggatccacctcaaaggctttaaagggagtgtagccttgagaacaacttgattttggacttttagcctccagaactgtgagagattaaattgctcttgttttaagccaccgaatttatattaatttgttatggaagtcctaggaaactaataaaattattaatcatatctggggactatttaaaaatcattcaaataatagcattggatagtgattatgtatttgctaatttcctctattatgatgtatttattaattttatctgtaataagaaaaacaattgttgaggtagtgaagtaaatgcaagccaagaaatgagataataccccttgatggttatatagtgttttagaaaataaaagttattttaataaattaattatttcctctgaaatcttaaagctgccaagttagattaggtgaatcagaaagtgcaattatgccaactataagttacaagtttggagtagttatgtcatttgtgcaaataataaatggtagcaataaactaacagaatctcagtgaagaggcattgtttaaagcacctgtgaattgcatggtgaaatggacagtaccatggtcaagattaaaatcaatctcttgtttatcaattaatcagtaattccatcatccacactaactttgtacttgacatattaaaggaacattaatgaaaaaacaatcttttaacaaggcaacttactatatagccaaatttttaaaaatatttaaaaatgttttttttcttatgtaatttctttacatccttcccacttgcaggtctttgtaactatgtgtgatacctagaccaaaacttttgcaataaaaattcattcacatgtaagaaaaccctctcctaagtaaaaattaattttaagcagtgactaccttactatttttcctacctgccttgaaacatcagggctttattacttctccttatggaactgccattccagcctcatattgcacgtcatttccaatctctttctgtcccacttgtattgctctttatgccgtgcctactaaatacaatgcttcctttagttacagtgtcattgacacatgctgttccattggcagtaacagcccttctcatcctctttgcccagagagcaccctttcaagcttagaaccccaccaatcatattttcttgaaaaaagcttccatcaattttctgaattaatgaaatacttctagtatacactatcatgatcacacgcatatctccatcataacctggatgtcacgttggagtgtcatatttattatcagataaaaatatgtcttattgcgcagtgataaagtttgttttcacacttcctttttaaccttaagacttaaaagagtgcttgaaactttagtaaacagtcagtcggtattttctgagtcaagggatagaggattgctggtgaaataatgcctggactctattctaggctctaacagtaattgggctgattgttagattggtcaaactatctttcctttttgagtctcaattttcttatccttaatgtggttataaataaaggatgtgatatgaaagcgtagtgcattggctaaaatgtagtacacaccaaaaatttatttatacttgttattcttttttttcgtgttttgaagaacaaatagttccaatattaagaaacagattctcagtaggttaatttttaataaattaactgcttatcaaaatgtaacctaactgtgcaaaataaatttctgaaggagcacttttatgtgtgacaaattaaacattaatagcaaaacaacatatattttcctaaattatacagattaactcattcattagtttttataggaaaccatgcctcaaatatgaaagacatcttataaaaatacagtaactagttttgaattattaattcattaaacacatatatttaatgcttattatgagttaagttctaggtttcagagtgggactatctgaattctacactgtttcctcaatacaattacaaagttttacaattaacaaagataaacaacggttttcataaattgtaataatcttatatatgcataatttgaattaaattttaaataaactaagtttctaattttaaaattaagttttattaattaaaataaatttaaatataaaataaatattctaaatagctaaataatttaaaattatattgtattaattaaaatatatttaaatatatggaatgtttattttgatgtgatggaatctttatttattttatgttgataataaaatttaattaattacattgaagtcttagattttcatacaatctgaaatgtagcataggaagccagaggacaacattgaagataattttaaactattggtaatattgtgagaataaaacatcatttatatgagtattagaaatagtataatgacctcccaaaaagataatcagataataagcatatgaaaaggtgctccatatcatatgtcatcagggaaatgcaaattgaaacaagaaaccaccacacacttatgaaaattaccacaatccagaacactgaaaacaccaaatcttgtcaaggagtaaaaggaattatcattcatagcaaaatggtacagccatgttggagattctctggcaactgtttacataactaaatatatttttactgtatgattccgcgaccaaggaccttggtatttatccaaagaagccaatctgagaaggctacatactctatgattccaactgtgtgacttctagaatagacaaaactatacagaatgtaaaaggatcaggggacttaggcaaaagcaaggaatgagtaggtggaggacagagtatttttagggcagggaaacaactctgtatgactataatgatgaatacatgttatacctttgtttgaacctatagaatttagaacaccaaatgtcaaccctaacgtaaactatgcattccggatgctaatgacatataattgtagattcatcaattgtaaaattaaaaaaaaattaaaagcaccactcaggtgaggaatgttgataataggaaaagctatgcaaatgtggggcaggtgttacatgagaaatctcaattttgctataaatctaaaactgctctaaaaataaagttaattatttgaaaatatgttggatatatttcattatttttaaaaataactaaaaagtgctcacatattgtaaatgaggtctcaaagacaaaaactgtaaatatgtcatttaaaatttggtaaagtgtttaaaataaaaaattctaaagttaagacatttaggtttaattaccagtacatccataactgactatgtgactttaggaagtaatttagcttttctaagcttcatttctcatcatataaaaaaacgaagaagtagaatttttctcaacaactagaatgaaaagaaaaaaattcacccaaatacatatcaaatggtaacagcatacaataatgaataatagaggctattactaatgaaaaacattacatcaggtaatattttcatattatactgttatttttatatctgtattgtatcttacatacaacataattcaacaaatattttctgttttatcattcagaaaataaatacatagatataatgcatacatttaaatgagttccttttggaaacaaaattatttactgagaaatactaggaaaattcaaatcaaaatatgcactttagtgctttagttcttaaattagacaaaatatttttaatttcaagcatgtcaaactatgttttgtagcgtattaacaaataggagtttgtcataagagctaatttcagggctttacaatgttctgacttgcattggaaacttttctgaaggcaagttttttgtttttgtttttgtttttgtttttctagagaacactttgatatgaactaatgagaagacacaggaaatgtttgaatacttatacaaaaatctatactgcagtagaaggtttatacaagagttagggcttaaaattaatctggaaatacatcttgacaattaattttagtaatattaattagtggtgtaagcaattaagagctattaaagataagtgaaagtaactatgatcttagatatttattattgacatttaactgaaattagagttcatagtaatttggaaaataaagatattgggagaataccataaggtatgataacctggattctttaagaaaataataagactaatataaaataattttaagggaattagtagacaaggacatggtgattttgtgacaacagccaaagaataaaaatacacagatgactcaaaaatcttgagctggacagattcacaatgatagacaatatatggaaggtaggagtccatgtcttaggtaaagtctgtcatctaagttagacctgaggagtctgcaatggcaggagaatttaaattcagtttatttttacatttcattcattcaacaaacatgtatcaggcaatgttgtaagagatgctagttatagtcatcagcaagactagcacaatctattccttcaaaagttttatatcctacctaaaatgacagttataaaattaacaattatgcaattagttattgaatcccatatgataaacatgtcttaagagaattctgtcctgtaggaagacttccttgaggaagtgacattttagctgaacctccaggtggcttttaactaagtaaagagattgaaaaataagtacaaaaacaagaagaaaagaggcattaaattaggattagaatgtaaatgatgtcagattattcagacaccttagactatgcttagattttggtcattaacatgaaaatgttgtaaaaatagcatgaaagactttaaacacatgaatgatacaagaatgatgacactgacatcagattgattctagtgcaaagacagattagaggtagaaaatgagtgtggggataccatttaataatctaatgtgtccctccaggagaaagatgaaggtgtcttggcctagataactaagtagatggtggtacattctttgattggatggacactggagaagacatagtttagaaggaaatctgcttgttgtaagtatgtaatgtgttgagtattagatttctgggaagtaccaaggaagctattgaatagatagctatagctcagaatgtaataacataatgcaagacataacacaaggcttctcacgtgtctaaagttggataatactatttgtgtgtgtgggaactctgtcatctacctagaagagacaaatgaagctatgtgagtagagagctacataagaaagtgtatttgattggaataccaaagggttcacaactgaaccatttcaaggctcaaaaagaaaagtcagatgacgaaggtgataaggtaactagaagaggtatcgaggaggaacaaacagggtaatattttgaaaactcgacactttattcaaggctataatttttattcccgggagagtgtataatttatagaagtgtatatggcaagtttctgaatccttcagcatgtgcatatacagaatataatatctcacatacactttgatattgttttagagctatttcttagtggtgtctagttctcaatttcataatacattttttaaccccaaatcaaatagatttattttattttgcatagtaacaagcaaaattttgcaaactataataatggctacaattttctgaaagctgattgaatattcagtgactttaaagattaacacatgaaatagtaacatagctcataaaaaacgtggaatatttgttaaattaagattatatataggtatatacatataattactttttaaaatagaatttaaaaaatcaaccacagcatctataaattttaaaatgtaacaataattttatcttgaaattgcataagatcaaagccacataatttttataaaaaaaatctcactcaacaggttatagtggagattaaatgaaaaaagcgcatgcaaagcatttgccatgtatcaggcaaataaacattcaacaagtattaatttctatcacaatcataaaatatgtggctacttttagataatataatgcacagtaattcttgggaggtaagtggctgtcatctacatctgcatgaacatgcacatacacacacatatgcacacacacatacacatacacaaacacacacacgcacacatacacacacataaactagctgagtgcagatatgtttggaaaccactggattctatatcctttcttaaagtattataatctaagctataaaatcaatgttacaaaaataaaaataaagaaacccaagtaacttgagttttcttttcttttctttttaattttttaatttttttaaaatttgagatggagtttcactcttgtcgcccaagctggagtgcaatggcgtgatctcccatttgaatataaacactttcatatagcataattgggaaaaactggtccagaaagtgaccaatttgggtctttatgaatttgaatgattcgtataatttgacatcttaataactcagggtccacaaatatctaaatactaaagcttagtcacagaaaagataatggttcgttgtgtggaatccttcagatttagacatgagcaatagctgaggtgtttttcttaaccatgatcaatttaagagatccaaattaaaattattctggctaattaaaaaaacatgtaatcattgtgccacttttcagagataaaaataacctaaggtatatctacatgtataaactgaggtataatatcagaacttgtaacttgagtgattttgataatcaaactggacaaatgttaccctacttattttagaaaaaacatcccggacacttatttaggattttattttttgaaaattttttaaaattagattttattatgacttggtggggtagaccacaattaaagtgggatacattttacatgttttggctctaccataaattttagcatgacttaagaaaataacagaaatgcatacatgcctgcattctgtaaggactgtgctatcctttggttcaatgaaattagcatgggaagagagcagttccatttttttaccctttcatatattctattagaaatcattttttccaaactaagaaactaacacaagaatcctatgtggctatcaattgaaatcagtacagatttcacttcggttagtttaaaaagcattgctacatttttagataagcagtgaaactgaaataaaaagtttctcagagaagatatttctaaatgaagttagatcacgtcagtgtgtttaactcacagttttatgtgggcttcaattagacatagaatgtataaacctgcagatgagattaaccatacacataactttgagttacttttctatgtaacttctttgaacataacttcagattttaaaagttgacatagaatttccaaagttgtgagctttctaaactggttggggaaaattgtattgaacttttattcaaaagttatttatattgaatattttactttatttcaaaagaatattaggtactgcactatactgtatacagggtagtataataaaattaataactataataaagaaatcaggtaaagtgagaagttgtattgtattgtattatgtgatcaggataaaagctaggaagcaaaactgctgtcaaattttcctacataaaggtagctgaatattacaagttcaaatgtcaggtccaaataaccaaagcaaagcaaagcaaaacaaaacaaaacaaaaaaaaatatttttatttcataacacaaaagctgaaaatacataaaatacacttaatatactattgtgttagtaaccttgatgcaaatacatgacagacagtcagagaaagcaattacttaagaaattggagtaaggcaaagagagataagtccaaccaatctgtcgaggtatgcacacatccaaacgtctgggctgattcggaaataaaatcaaggatcaagaacaatgatctgaaatgccctcagaagattttaggatatagtaaatagtaaatgtataaaattccctgctgcaatacagtgttgaaaggtgaagactgtaacaaatattacagcacatagttcgctgttaaaaacaataaacactgggtgtccaaaaccaaaacctaaaaacgaaatcgaaaccaagcagatgtggaaggaaaatgatgctctcagacttacagcattctcctgtatccagatattcagaggaatatctggggtataactcaaaaaagaattcaaggttatagttactaatcaaattccttagtctacatatattctgtttttcaattaggggagaatcctccacttagcaatgtacatgtgatttatacggctgtcccattaaattaattgtaccaattgagaacaatttacacaaatgttttacggaaccatcatcgaaattaatatgtcatgatatatattaccttttgtttttccctacataccttctcaaatttccccacattcagtttgataaggactttggcagcaatctacatttaattttaaacttgcagaaaattgggttctaaacgtgtaagttatacgtcagcaacaaagcattatttatgattcttaagaaacaactgtgactttgagtcacaaatcatagagctattgaaactcccagctggaaggaaccttggagacaatctaaccgttttattcatgaagaaatagctaactagagatcaagaaattgacaaatggctttgcagtttaatagtgaaggcaggattagaactcgagtctcctgactccaaaatgaaaacttcaccactatcttccactatgacttttgcttctcataatatataacagattaacaacagagacttttttttgtattgtggtctgctagatatgtgttaaaaggttctactgaactgaatatattaactctaaaaaatgttggttttctcttatagtaagttatcacaatgttgatagtgttttaataactgcaatatgttttttgaatatttggatgggaaaaagacaaattttttcttcatacggtagaatcacatattgatttggaataacatactcctaaagtcaaaaccaaattattagtacttttttcccccgaatttagttatttaatatttcaggtaaatttataaagggattgtgaaagtatggaatgtgggagtgtggaatttacaaagaataatttcagaaaagcaatagtgtaaagtcactagctaacgtgtttttctccctttattgtttaaaaaaaagtttctaaacctcaaatatttcaataacttgtgtcctaatcttaaaagtccatcttcttactggaagatttgatgaactaacttctgctaagtatagattcaggtgtttccttgtttgttctggtaatttagcttttaaaatttatgtattcttgtaaaaaactgtttaaaattcaaaagtaaaaataacagagaatagtggaaaataatttttccttctgctgagacctcaaactaattatcctccttgtatcaaacactgatttaggtttttgattatacttttagaaatattttatgcacttataagcatatgtattcatttattttatatatatacatacacatatatactatatatataatatatatacatacacacacacacttgagataggatcttactctttctacaggctggagtgcagtggagtgatcgtggcttactaaagcctcaatctcctgggttcaagtgatcctccatgtcaacctcccaagtagctgggaccacagacatgcaccaacatgagtggctaatttgttttttttgtttgtttgtttgtttttttttttagagatacaggtctttcccagggtggtctcaaactcctgagctcaaccagtcctcccaactcagccttccaaagtggtgggattacaggcatgagtcaccacacgtcttattttatatgttaaagaaagcattcactaatattctgtccttaatatttattgtaccaaaagccactttggaaagaaaaaagtctgatctatcctttttggtaacagatactaagtttctttgtcatattttaacaagtctatatgtgctcctgattaccttgtatgtgcaaggtaatgtaagacatacagaaaaaaatcaggcacagtgaccaccatagagaagaacactgacaaaacctgatatcgttcttaattctatttccaaaagtattaccaaaacactggtttgatactaggagaccctctgttctcacacattttcttctgacattaaaataaaaatgccatttggacaaaatttactaaatgttttgggatttagctacatgtttctaaaattgttgttgcttattttttttactaggtttgttgaagacttaaaaactaattttgataatattcatatggcaaataagcagtctgatgtatttctctcctccttaatgcaaagctcctctaataaagcaatctcttttattaagcccaaattcaaaatcttagttgattcagttatgtattcgctatttgtatgttcatgagaatcatacagaagcttagaaatgatattattattatctagagtagactgactataaaatattaattcccttactcaagtaaagaatgtagccaaataaatgccactcatacattttcattggcgattgaaatccctatttcagtgactatttcagtggctattcttaaggagatttggagagagggcttacactacactaacttgtggttagtgttcttattaatgcctaatatcagaactctttctgaaggggaaaaacattttgataagtgttgaaaagtgttccattaaagtaaacaaactttaataagatgcaattaaagaggtgctggaaacgagaggtattaactttacctaaaactagtccattttcttaaatcaaaatggtgtttatgagaatactgactcgtggaaatttaaataatgtcttgctataaaaagtttgagaatagttaaaccctgttagactggctactttatttccatatttgcaatttaatttaataaagctattttgcactgtatcctctataatcaggattagtattttccaaactaatttaagaattattttgttattctagggtgtcttgtgggattaacgctcctagaatgcacttccacacagtgtttttagctactaaaaacctggattttagctacagtatcatgccgtgggcaaataatgcatggtaccctgagggcttcaactgtgatttttatggaccatctctctttgcctaggtcaatgactaacaggtatttgagaattcttccagtgaacctaggggagaaaattgttggtttacccttgctcagataccacagagagccttttattttaagaaccttggcaccttttgtaaatacaattggcagttggaagaatgaagtgtattaaatgtaaagattgttttctagccacaggggtctaggccaagccactggaaggattagtatatcatatttcttcagacatttgcttcagtgttttatcattctcagtcacttgctttcccaaagcagaaagaacagaaggagaagtaattaaatacaatttcttcctcctctacaggaaaccaagatgacaatggcaatttgttaccttctggaaataaaggagcaattaagggagaaataaatcttcaaggattttcctaaatctttaactcgttttacagcagcctattaccaagtgctactgtgtatattggcttcatttggaacattgtcttacctatatttgacacttaataactttggtgattaattgattgactgaacaaccactggcaaaaagagtaataagacgtaaaaagtaatcgttgagcacattttaagacaacgtgattaatgttctttgtagaaacttaagaggatccaacagtccacattcatagaaatattgtaagaaacagatgaaataaagatttatgaaaaggctagtgttttctgtattcaggctcttacttagttacctaggtgtatgtagtgtgtccctgcctcattgatgacatcaaaactgcattcttgtactcagttctgctaataaaacctaaacttgttttgctctgtctgaaacttgatcttggtcatctatgtagtattctctagtattgattatgccttttttgcttatctacctttctttcaattagagttcatggttagaatattacatcatattaaagatattttttaaaattaaatgaaatacatgtcagaaatgcttggttataaacacacaattacatcacaggtgataaaacggataatgttggaacaatgtacataagttatttaatatttggggtttatatgttgtgaaatttaatcacaaataagcatttaattataataacctatatactttttattaaaactttatttttatattgatataaagatgtagaaataatagtagctataactcttgctgtttcttggtattttctgagtatccttttcatatttgtacaagcaaaggacatttagactgcaattattgctaactatatattagcaccaaacactactatttttgagaatactttatgagaagctatcttttgtagccaccttcctaatcttctacttcaattacacttttaaaaaggtgtaccaaacatcaaaatatttacatttcacatctcagatgcaaaattttatcttattttctttaaaccaagatactcaacgagtagactagagatccatggggctggttggcatctttttgaggagtcttcaaaggcaaaacaatttctaaatattaataagatttttttttacccactaccattctctcatgagtatatagtcacaattttctaaggatttagaatgtgtgaagatttcatataataaaacattttaatatatgaatacctacataacacagtgactaatattttccaaatgacagatgcatgatgttacaaagtcattcaaggtaagagatgccatcaaattacaagattgaagcgtgcatttttggaaacaatacaaaaagtttttgttaagtggtttcagatttctcattgaagctacctttaagaaactaccacttgatgagatttggtatagtattgtagaggtcaagaaaaaacttcccttttgttctccgaaagtttgctgaaaatcactggcaaaaggcagattaacaggagaaaaggcctacaaatttattaacatgtacctgggagcctttagaatgaaaatctaaagatacatgggaaattgtgcattttaatgattgggttcggcaaagcgtagacagccgtgtaaaaatatgattagacataaaaagcgtaatcaaatgttaacagactgagtggggaaacccagcaatacttgcctatctagattcttcttgtcctctctgagcacgtattgtgtccctctgggtatgggacaggaccttttgataagggttttatgaactacagtcaaacaaagaaggtcaaataatttctttatgaccagtttttacacagaaaggcagagggaaagttagaataatatttttaagttttatggctggctatggggaaatggagttgccatttctattacctgcttagagaaagagagattgtactttctactctagcttaggtggacaataggactgacaggcaggagagcaggagaaggtcagagaaaagttttggcttctgaggcaaaatatatatagatagatagatagatagattttttttttttttttttttgagatggagtcccactctgtcacccgggctggagtgcagtggtgcgatctcggctcactgcaacttccgccttcatgttcaagtgattctcctgcctaagcctcctgagtagctgggattacagaagctcgccaccacaccaggctaatttttgtgtttttaatagagacggggtttcatcatgttggccaggctggtctcaaactcctgacctcaagtgatctgccttccaaagtgctaggattacaggcatgagccactgcgcgtggccggggcattgtttttgagtcccaacagcacctgagaataatattttctgtttgaaaaggctactaaatacccctttgtatttcaactataaatcttggaaggctacatttatttcccataatccaagaaaaagacttgttgtaaaagattgaatgcagaagcagatgtgagaatctaggtgtctttcattaaggtagattttttcccactattgtttggaaaatattatttttttcattaaactatgctatttatactaataaatagcagatctagtattatctttaaattaattaataagtagttatgaaattcacaatttaagttttcatctagttaatattgatatgtatagcccacataaagaaaagttctttgtggtcctaaataactcttaagaatgaagaaaatatactgtaaccaaaaaggtcgagaaatgccaccttaaaaaaaagtcatcatgcaaatcaagaaattggacacgtgcatatccttattctaatgtggctacttctcttatatttaatccacatgattgtttacattcaagcctttgtggattattactctctgtaaggcttctgtgcatcttcctttcaaaaagaattttcaaaaatatacctttatcctttgttagtttgtgttgtaggaattcagatttccaaagtactgagaaatcttctaattttaagctccacacatatttatgtccctggaaagtatgctttttaatctcattcttcgagaaaattatctctgctttccttattacttggcttctgcatgccttgttttatgcatactttttgatatggtttggctgtgtccccacccaactctcatcttgaattgtagctgccataatccctatgtcttatgggagggacccggtgggagataattgaattgtggacggttcccccccataccgttctcatgacactgaaaaaaatctcacaagatctgatgaacttataaagggaaacccttttgacttggttctcattctctcttgtctgcttccatgtaagatgtgccttttgccttctgccatgatggtgaggcctcccaagccacgtgtaactgtgagctcattaaacctctttttctttgtaaattacccagtctcgagcatgtcttcatcagcagtgtaaaaatggaccaatacacttctttaaccactcatcaatcaaaaactaaagaaaataatttcaaggaggaacacaactcagactgtgtctttctgaatagcaatgtctgcctgattctcccttggagatggcagaagacacttaaaagcatttttttttcctgctagcttcacagcatctgcaaatcacacagttgttactttttaccacccaagtcttctccataaattttagaatcaattggcgagaagaaggatcataggtaataagttcttttatatgaatatttgaccagatgccttgggattcataatacttgatatttagtgctttgtgactgcaagttaagccaaaatttaatacaatcaaatagatcattcaatttaggcaaaaaaatttcagattttttttgtgaatttgatcacatgggctgtgtatttcaaaactgctcctctgtaattttatatcagctaatggagactttatataaactgctaccaactataaaggctcaaatttaaaatgacactaaaaagttaatgattttctccaaaatgagtacagaacagaaaaacaaatcctgtgaatagaaatgacacttataaagaaatataggaataaagctaaattaactcactaaagaactactaagggtatttgaaaaagataaagaatataaataaagaggttgaaaaaaagtaatttaacatgattttagaggtaagagaggttaaaaaaactggtaagtcaaatttaatagtaaaatgttagcaagtccttcaactaacagtttacttgtgaattggtcaacattgatgtttgttgttgtttgcttcttttacttccagaaaaaccaggatgtaaattaacaaatattaaatattttgagcactgaagtcctattagttttcagtattttaggatcaaaaggcacttctaatatatttaacttggaaactctatagttatcttttaatacctgagaaacccgtgacccatgagctccaaagtcaaaatgtggatgcctggcttttactcttactcatagttcattgttctacattttactaaaattatacattggcataaagttttagtaaataaaaaataagctggtagaagaaataaatggacaaaaagtggccaaataaagagaatagtggtttttttacaaaactaaacatgcaactatcatgcgttccagcaattgcacttttgagaatttacctcatagaataataaaacttaagttcatgctaaaacctgtatatagatgtttatcgcagcttatttctagtagcccaaattggtaacaatccatacaagttaatggttacacaagctgtgctacatccctaccatggagtactattcaacaatacaaaggaacatactattaatactgacaaacattatctttttgaccaactctagccaggctcctttgagttctctttcaactagacctaaaccttggcctatgaagatttgagcaaaacagtaacatagtttagtttctaacagctaaagttacatccctaaaatgaccctaactctccttaaatatcacctgagaaaactgaaggctgagagacaggggctaatattaaagacaagttccctgtctcccagtctctgttggaggacaggaacataacttccattagcagcagttaacagactaagatgggtttcacatagaataactctcttctcccactgttgtaatgtttcacttccctaaccctactgagtccctcttccttattctgtcattccctctttaaagtcccaatcacctgtctatacaaattgcatgtcagttcatgctgaactctttttgatattgcaatagtagcttactgattaaaatctatccttgctactttaactcatgtcaggctttgtttatctttgacaatatatctaacagtctggatcatgaacaaagcaggagcactgtcatctcagacaaacaccgccacttttaagttccagctccctttctagcctcatgcatttcaaggaaatcacttctcttctgactacaagcagacagaaagagcagagagtaaaacacagataagacagctggggcacagagggaggttgggggagagtctcttgggtaacttccaaacttcaccctcatacaatgggccccagtaaaacagcgggccttaataaacacatgcctttcccttcagatgcactaagatagggaagctaaaagcagactcaggggatatgcctgcagctgcaggaagatgtatgcagacagacacataactctccctcccagataagcacaacaaagagacacagaagcagtccaagcctctgataaactctcccaccctgaatccttaaaaactcttaatctgggccggggcgtggtggctcatgcctataatttagcacttagggaggccaaggcaggcagaatacgaggtcaggagtttgagaccagcctggccaacatggtgaaaccccgtctctactaaaaatacaaaaaattagcctggcatggtgtcgtgcgcctgtagtcccagctactcaggagcctgaggcagaagaatcacttgaaccagggaagccgagattgcatttaatggagattgcaccactgcactccagcctgggcaacagagtgagatttcgtctcaaaaaaaaaaaaaaaaaaaaaaaacaaactcttagtctgtaagagagtgtggctctgacctaactcagccagctgccccctcaggtttatttaaaataagcctgtccctgttgactgaaaacccacccttcatgtttctctcctctttctttaatttttacagatcaccctccagcgaattatgctgagtgtaaaaaaaaaaaaaaacccaatagattatatactgtaaaattctatttgtataacattcttgaaaagacaagattacagaaatggagaacaaattcgaggtttctgggggttaaagtcaaggtgtgtggggacgggtggaacggaagtaagtgtggttataaaaaggcaagatacacgacccctgtggtgatggaattgtcatgcatcttgactgtatcaaagtcaaagccctagctttgatattctactacagttctgtaagatgttactatggcgaaaactgagtaaagtgtatactatatttttccgtataatttctgtaactttttacaaacatataattaactcaaagaaaaaataaaagtacatttatgtcattagaaaatttatagagctatatatttaaaatgtatgatagattttctccaaaatttattccattatgtgtatctttttttttacaatttcccagttgtgaaattacattaaaagcattgtttctctcaaaagcttttactataaatgtcaagcaacttctttgttgttacttaaaacctaagcatatgatgtatattacctcttgaagaggtaatgcaacatgaaaatgtttaatagatatgtgatattgaatgttacttaacttctctaaacctcttgaatcaagtcagtaacgcgggataaatgtacctaataccataacatacatctttgaggaaagaatgacatgtttataaggcatatatatatgccatatatatacatatatatatatacatatatatggcatatatatataaggcatatatatgtatatatatacacgcaatgtgtatatatatatacacgcaatgtgtatatatatatacacgcaatgtgtatatatatatacacgcaatgtgtatatatatatacacgcaatgtgtatatatatatacacgcaatgtgtatatatatatacacgcaatgtgtatatatatatacacgcaatgtgtatatatatatacacgcaatatgtatatatatatatatacatgcaatgtgtatatatatatatatatatatatacacattgtcacatggcaaaactcaaaactcagtagttacaagtactgtaactactatttataaatgagcttcatttatttgaaaatgaaaatcagactaggaagcaattaatttaccgaattatttcaaaaaattattagctgtgtgtgtgtgtgtatatgtgtgtgtgtgtgtatatatatatgtatatatatttatttatatgtttttattctaggaagaacataaatcattcttattctaggaacagaacataatatttccaatccactaaaagaattctccatagtataatgttaacttgcctaccagtgagcattcaaatgattgagaatgatactttataatctactaacaatctattgcaaatagagtattctgttgtgaaagtattctataaatgaataagagatatatctctctgattactcttctgtattcttttcaagaaaattccagtttgactgagatataattaacaaaatgtgtatatatttaaggtgtatgatgtgatgatttaatacatatatacatcaagctaattaacatattatcaccttacataattattattgtgtgtgtttgtctctgtgtgtgtttgtggtaagaatgcttaagatctactctcagcaaatttcaagtatgcaatacaatattactagctacagtcaccatgctgtatattagactccccagaatttatttgattacaactgtaagtttggaacctctgactaacccccagcccttagcaacaaccattccactctctgtttatttgatgttgtttttagatttcacatagaagtgagatcatatggtatttgtctttctttacctggcttcgttcacttagcataatgtcttttagatttatccatgctgatgcaaatggcaagattttcttctgtttttgactaaataatatgcactgaatatacagatgctcctcaatttatgatagggttatgccccattaaactcatcataaatcaaaagtattttaaagtcagaaatgcatttaatactggcagcacagcaaacggtcttcaacttagaatagttcacattacgatttttttttgttttatgatgatgcaaaagcaatattcagtagaaactatcaattctttgtaagtcataggaggcctggaacttataatagggtcatatccagataaactcatcctaaagtgaaaaattcataagtaaaaccattgtatctaccaaatattctctatttatctgtccacagatactttgattgttttcatatcttggctacagtgaataacactgcagtgaacatgggcgtgcagatatcttgtagagatgcagattttatttacattgggtatagagatgctcctcaatctacaatggtgatacatcacaataaacctatggtaagctgaaaatattgtaagtcaaaactgcatttaatacacctatcccaccgaacatcatagtgtaggatagcctatcttaaatgcagttggaacacttacattagcatggaaggctgggagctggagttcattgctactacccagcatcatgagagagtatcatgtggcatgttgctagctgggaaaatgtcaaaattcaaaatttcaagtatagtctctactgaatgcatattgaattcatatcatggtaaagttacaaaattataagttgaaccatcataagtctgaccagtctgtatatctagaaatagaattgctggatcatgtggtacttctatttttaatttttttaggaacttccatactgttttccacagcagctatgccaatttacattttatccaataatacttaagaattctcttctctgcaaacctttgcaaacatttgttataaattgtctttttgataacagtcattctaacagatgggatatctcactatggttttaattcgcatttccttgatgaatagagatggcgaacacatttttatttgttctatagatccatttttttctatagtgttattcaaatatgctatttccctattgattttctgtctggatgatctatccattgatgaaagtggggcattcaaattccatactgttactgtattgctgtctatttctcctttcagttatgttaatatttgctttatatatgttattgctccaatgttgagggcgtatatacttaaaattattatattctcttaatgattggcctctttatcattatataatgatcttctttgtctcttgtgacagatttgactaaaaatctctttagttttatataagtatagccatgactgctctatttagtttacccatttgcataaaataacattgctaatcccttcactttcagcctatgtgtgtccttaaaccaaagtgagtcttccataggcagaatactattggatgtttttaaattacttatccaccatttcttttgattggagaatttaattcatttgcattaaattactgttaggtaaagatttatgattactattttgttcattgttttttgactgatttgtagtttctttgttcttttctttctcccctgttgtcttaattgtgatttgttgattttttgtagtggtatattttgattccattctaattatcttttgtgtatctacttgagaatttttatttgtgattatcatgagatttacataaaacatagttattacagtctattttaaactgataacaacttcaactttgtctttcacagttttaatgttatgtctcagagtaatcttttttgggttgatccttttttgggatccattagcttcatgaatctgaacattcatattcctcctaagatttggaaattttttttaaataaactttctcccactttttctccctctcctccatcaagaacttccacaaggagtttattcactagtttgttggtgtttcacaggtgtcatatattttcttcatttttttctttcatttttctatttgttcatctaagtagcaattttcttttttaaagtctttaaattaaaaaattaataatatctttatgtataaaccataattgtagaagttctggaatacaatgtgatgttttgataagtgtatataatactgcattcttaaatcaagtaaattaacacgtccatcaccttgcttacctatcgttttttatgaaaatacatctgaaatttactatctttgttattttggaatatataatgcattatagacatttcacagggcgatagacatcaacaccaattatttctgtctatctgaaactttgtactctttgatgaacaacttgtttcctttttttgcaaccccctacccccagcttctggtaaccatgatttaatctctatttccatgagttcaaccttatcagattccatatagaaggcgaatcatgacaatgctaatcaaggtagaaaagttgattaacattgcttaaggccaacatctatacactagtctctattgtagtaacacatgctcaattgcattttttccctacaataatgttttgaggatagtaatgtcatctcctgttataaacaaataaaatttaaacctggatgtagaatcaaagcccacattcttttcactataccctgaacctactaaactgttccagttctacagtctcaggccaacatactctcaattattcttctatgctgccacctaccccaaaacactgctgaaaactggcgtacatgtaaaaaccttttttttttttagcagcatttctaaaaatagctaccttgtaattcaaagctactttcttattctttattaccatgaaattgaaatcagttaaagaacctcctcaccaaatatttagtactgaagaaaaagtatatagagtaaataattcggaaatatcggtttactttgtgggcactattcttctggcccaaggtttttgagttcagaagagatttggtacaaaatgaaaggagagacaagggatggttatatttaagtaaatagctccttcctctgtaattccatagtgccacacttccaatacagtggccaccagtctcttgtagctactaagcccttgaaatgtgggtataagaattggaaagtcttagtatgtaaaagaatgtaaaatatctcattaatggtgttaattataattatacattgaaatgatattttggatatttgacttatgttcttaaatgtattgcacctatttcattttacctttaagaaaccactaacaattttaaaattgcatacatatcttgcaatagatttctcttggtgggtaatttcatactgctttatccatatcacttgtaaatatccatcttattgtaggatgaaatattgcatgtatttgtttctgatacctcagaaagcactgaggtattggagtcattgtccatagcttatttattattcccaaagcacagctgtatgactggcacacagtggacattcaataaatgctcttgaagtggtttttgattagcttcacttttaaaataacaaaataaatttaaacatcaattaaggcaattagttaacttgcatgaaaacattttctaatacaactttacattgttgtttttaaacagatgaaactaaaattttaagtttaattactgacttccattaagtagtaattttatgtgaaatgtctcaacctttgctggattatgcatatgtcctcccattgccactctactacactccattgctttaaaattacttttataaaatgacctagatttagagaaatcattcacccagaaaagaatgcatcacggaactctgaaatgtagagtaggttgatcttagcgcactgtttagaataaaacagaaaggtataggcaagagtaacagatttggatttcagtattgtgaatttttgttacaaaaataaaattacaattcatattgaatattgtaaatatctcagaatttagaaaaacaaatggctttttacagaacattttttattaaaaactgctacaaccatccaagctatgaacaatatgtgaagacacgtttcattccctaggtaagttattctcatcataatttttataatagtgaaagtcactagatagataaataatctgagaatgagcatttattcaaggttgaggcttgtatatattaaacactttaaattgttcacttctcatataaatcatatgttatcaaaatattcattgcaatattcctaaatttttaaagtatttctgcttataaggaagtctacttttggcttacatgtatttcttcttgtaagttgaaagactcttttatttatgacatattaaacaatttcaaactctatctaaacttccaaaacccaaagatatataaactttgcaatttgacagacaatgtaatttttcttgaactgaaatacattcaggaatatagcacgttcttttaaagtattttcattttatggaatcaaagtaactcctaaatctgtcttcataattttactattcatcactgcagaattaaggtgaaatcaataatgtggtggcagcaagtagcacagaagatcagagagaagcaaactgaaactgacacctttagcatttgtgtgactgacagcattctgcaaaatagctaatcatcctgagaagactctatttcatgaaaatgagtcattagattgagagttgtcaggatcaataaatgtgcattttaaatgtatagttaacctaatttcatatgcaatttgtttaaaattatttccttctcagatattcagtatccctcacttaatggtgttactaaattataatgaatgactgtggactggaataggtttttgctactaatagacaagacagtggttgtatttgactaataaattagctattaaactttctaagcattgacttataatagataatcaacacaattctatttttttcatttcatatagtaaaaagtatcattattctgaagtttaagacaaattcatctgtgtatatccaatacgtagaaaacaggatatgcttgataaatctttgtggatttagtggatgggaaaattcaaaatattcttaacatttttagccaaatacttacacagtaatttattttttatttgtcatttaaggttcaactagccccagaatgtaattaatatttccctctgcttccttaatatctggcaaggcttccttttaatacttttttctttagcacaacaccttattgtgagactctttctaccatacaaaatcactgttatacatgagtgctttccatcaagcaatgttttctcattctctactcgagtgcatctttgcaccactctgctattgatttggggtctttgacagactatcacactcaaacaacacaatcaggtttataatttatgcttgtgactgtgtcattaaaacttgtcagtaaatattttcaaacttgccatttcctaattagagattcacaggggaacacttgtagaattcaaaggaatggactttcaacttctcagagtaggtattaggtcacaaaagccatatcattcaaatgaattagacattgctaaaattcttctattattactgctaggttatatttataggcaacgtcatgaagtggcagtacaaatctgtatcagttgtctatacactgcctagctgtttttattatgtataaagaagagctactgtccctggcaagcattgcttaaattagtataaatgtgattggtctatttgcacttcagttgaattaaaggagctagatggaaattttttcctaccttgttaaaatttgcagcagcaagaaaataaagaaagaatgggttaattttataggtgacattgcctctggtgcatgtgtatattcgtttcttatgactgccataacaaagtacaacagattgagtggcttacaaaaagagaaacatattgtctcacagttctggtggctagaaatccaaggttaaggtgtcagccagaatggttccttctgaaggctgtaaggaagaatttgctccatgcctcttgcctaccttctggtgggtcactggtgatcttgtagattgagcttcatcttcatatagcattcttcctatggagtgtctatgtccaaagtactccttttttaaaaaataaaaactccatttatgtagattagggtcgatttactccaggatgacttcatcttaaggaattacatcagtaactacttccaaataaggttatattctgagtttctaggtgtaaggacttcaatatataatattgtaagggactcagttcaaccaataataatatgaaagtatgaatatacatgaattttgttttctttcttattaagtcaaacttaatatcaaatttaatattaaatcaaaaaagagaaagaataaaaacaaaacaaaaatttgacttttatgtatgacttaaatttaatgctttggcaccctaaaagtcctgtcttcagctgttgtgaatgtacatttttaaagtgcatccattattaaaaaataaataaaatatttgatatttcaataataggtattgttttttcttctgacaacaatgaggtagctaatttgcttctttataaaaccaagatacacttctgagtgcttaacaagtgccaagagaagttaataacattttttgtggacagaagagaaagcaagctacactgatattggtctcaactagctgctacctgagtactttagcttttacaaaaatttttttttaattttctcagacaagttctcactctgttgcccaagcagcagggcagtggcacaattgtggctcactctagacttgacctcctgggctcaagtgatcctcccatcttagcctctggagtggctgggactacaggcatgtgccatcacactcagctaattttttattttattatttatttatttatttatttttattatactttaagttttagggtacatgtatacaacgtgcaggtttgttacatatgtatacatgtgccatgttggtgtgctgcacccattaactgctcatttacattaggcatatctcctaatgctatccctcacccctctccacaccccaaaacaggccccagtgtgtgatgttccccttcctgtgtccaagtgttctcattgttcaattcccacctataagtgagaacatgcggtgtttggttttttgcccttgtgatagtttgctgagaatgatggtttctagcttcatccatgtccctacaaaggacatgaactcatcattttttatggctgcatagtattccatggtgtatatgtgccacattttcttaatccagtctttcattgttggacatttgggttggttccaagcctttgctattgtgaatagtgcctcaataagcatacgtgtgcatgtgtctttatagcagcatgatttataatcccttgggtatatacccagtattgagacggctgggtcaaatagtatttctagttctagatccttgaggaatcgccacactgacttccacaatggttgaactagtttacagtcccaccaacagtgtaaaactgttcctatttctccacatcctctccagcatctgttgtttcctgactttttaatgattgccattctaactggtgtgagatggtatctcattgtggtttttatttgcatttctctgatggctagtgatgatgagcattttttcatgtgttttttggctgcataaatgtcttcttttgagaagtgtctgttcatatcctttgcccactttttgatggggttgtttgtttttttcttgtaaatttgtttgagttctttgtagattctggatattagccctttgtcagatgagtagattgcaaaaattttctcccattctgtaggtttcctgctcactctgatggtagtttcttttgctatgcagaagctctttagtttaattagatcccacttgtcaattttggcttttgttgtcattgcttctggtgttttagacatgaagtctttgcccatgcctatgtcctgaatggtattgcctaggctttcttctagggtttttatgggtttaggtctaatatttaagtctttaatccatcttgaattaatttttgatgaagtcctgctatgttgctcaggctagacttgaattccagttctcaataaatcctcctgccttggcctcccaaagtgctgggattataggcatgagtcactgcacctgggcagcaattttaaaaatctattaaattacagtttatttacaaatccatgtgagagatacaagatgcatttgcttttttatcactttacttttaggatcacatatacaggtattagggtgatctgataacttctcctgttctttactaatattggcataaattctgcctttagggattataaataaatatatatatgtgtgtatatatatatatgtgtttgtctgtgagtatatatatatatatatatatatatatatatatatatttgattaccacaaatacatatatgtttttgacagtccctaaaagtgtgccagaattagactttcatgcataaaaataaagagatttgagctttcaatcatggatatgctacgttaatgctcctcaaagtatttacttacaaattagtaggaatgagtgaatcaactctaaaactgacaaagaaatgttatccagagtattttaaagcataaaaaaacaattacctgagtgcaataggagtataacaagtgaagtcacctttattaaaatgagcattgtctcattacttttcatctctttcaatctaatgtcttatttcactatttgtgtataataatgacatatttttaagttcattctttcttataataaggagtctaattcaattttttaaatgtttaactgtcgtcggcttttgagcagaacccctgtatttggcatgtgctgggaattcagagtatgagcaagaaccctcatccctatacaattctctaaccatcattattattcttatccatctcaagttaatttttagctcagttggaagtcctgacactctctccccaaaaagcttcacatatgaattttaaaaaaattcatatactcttgtatatgtgaatgtggcaccattactatgacatctaaaccaaatctttccctcttgtgtacatgacctgagccaaatcttgagtgaggatctattctgattctgtaggatgactatgattttgctttgctcagctatgttctttaaattattagacatctttggatgaatattcttttttacattgttataatgtttaacaaataaaaagtaacaacataagtccctgaattaatagaataaagtttagagaagtgggaaactgttccccatgataaatataaacatcatttattttctttggtttatttttgtcttttgggggcctgaacatcacacaaatgtctttgtggcctatctctggaaaattaattattttaagctatctaaatatatttaattaaattctatgcatagtagaggaagcaggattattttaaaactaattatacataaaattgttgtaggtctggcagtggagctgatggttcttatagctttcaatagtttgtgtacagttattttcaactatacattcagtgatgccatgctggtaacttgttttaggctgaagtggaagtatttgcagcatcacaattgtcaaagtctacaaattagggttgcttttgtttgtttgtttgtttgtttcagcaccgttgtattttacaaatataaatacaggtgaatgattttattttggcttcaacaataatgcctgtctactagttactaactggagtgttttagctatttttaaatttattgaattacaatttgctcacaaatctgcataaaagatgtagtgacaagttcactttcaataggttaatttggtttttatcttcctcattgctacctttaaagcctactggtatgcaagcagtaaaaaagtagactgaggacacattatgatcaagtgttatctatcttatatcaaatctacttgaattcgttagctaggcaacagttttcttcaaacatgtttttcctcataaaaataggtaatcttttacataaatggctcttattaatggctattaaagtagactaaagagctatttaccaatgtgtgaataccatcttgaaaaataaataagaatctctggaagcagaaccccaagatattttaattagaaaccaattctgaaagccacgcatatttttctatgggcaatatgactacccttcatttcttacaactcaaacttgaccttctgaatatccctcattaagaagatatttccttgataagaaaggagagccacatctgtggcagtgactaaaattattgtgcaggaattgtttctggcgagtaattgaataacagatgttgtagccaaattgccagatcattctcacattcatgtcaatgagaaactactaagcacaaagaattattttgcaacatatgacatcaccagattaatcttacgtgtgttaatacagcaagtgatagcatgtcataaagtgtttatatagagacctgtgtaagagatcccttaaaacaattaacatattgaaagaaaaatccttatatctagaaagcagaagtagcagaaaaactattggagactttcaatgaatacgaagaagtgaataaatagattttttttatcaaattaaagatctgatctttgtaagtaattctgttttggaaatttaatgaataaaatatctaaactatgaataacagttgtacatagctatttataattttctaatatttatttatcataaagatataaaaagagaatcaataaagcaaatactacatgactcaagaactacctaatacacaggacatagcatattggtacacaataatttcttaaatttctcatatcgggaaacagtctcttgaggggttaaggcagctgctcatgttgactaaactagtaagaggcataaccagatttaaacctttttcctctaaacatcttaatacttggtgaaacttgtttcacaatcttttctgctttttttccataattaagggtagctatactcagtcgcttcattaattccaacctcatgcagtttatttatttaacaaacattttctgagtgacttctatgtgctgtgataggtgcaatggattcaaaagtgaataaaacaaaatagttttgctcttgttgaacttagaaactagtaatttgaagaagctattattctagtattttaagacttcctaaagccaaacgtaattaagaaaaagtataaacccagatatgctggatgaagcagctttgtgttctggctgcctctgaagccaatgggcagttctagtggtgtaggaggtgacagttaaatgctatagtctttgatagattggtgtcaagatgggaacaggtgtttggctggagaattcctgcacatcaggctgtatacatttctgccagcagggtaaaatatccttaataactctccttcacagaatccatgacagaaataatataaactggaattcctatgaagggaattatgtctagtttataatcttactgtcatgattcaactcatgattgatcatgagctttcaggaagacagaactgaccaccattttgtaactttgacatttctttacagtttctcaggacattaaaatttccaattcctacacatctccttctttgtcagtcactgatcaaatgaacacttgtcaaagtaaattttcaaaaagtaaaacgtccctcaaattagtaatagccatttatgacagacgcacacccaacatcatactgaatgggcaaaagctgaaagcactcgccttgaaaacggcacaaggtaaggatgccctctcttacactcctatttagcatagtattggaattcctgcccagagcaatcacacaagtgaaagaaacaaaaggcatccaaatagaaagttctcttctcaagtcaaactctacctttactgatgacattattgcatatctagaaaactctaaagacttcaccaaggtcttactagaactaataaaaatttttagtaaggtttcaggatacaaatatatgtagaaaaatcagtaacatttctatacactaataatgtccaggctgagtcaaatcaagaacacagtctcatttacaatagccgcaaataaaatgaaatacgtaggaatacagctaatgaagaaggtgaaagatctctataaggagaactataaaacattgatgaaagaaatcaaagatgacataaatgattggaaagacattccatgctcattgaatagaaaaataagtatcattaaaatgatcatactgtccaaagcagtttacagattcaacactatttctattaaactaccaacttaattcttagcagaagtagaaaaagactattctaagatctatatggaaccaaaaaaaaagagcatgaatagtcaaagcaattctaagcaaatagaacaaagctggaggcaccacactacccaacttcaaactataccataaggctatagtaatcaaaacagcatagtattgctacaaaaacagatacatagaccagtggaaccgaatagaaaactcagaaataaagcctcacaattaaaaccacctaatttttggcaaggctgaccaaagcaagcaatggggaatggactccctattcaataattgctgctgaggtaactggctagccatatacagaaggataaaactgaacccttacttttcaccatatacaaaaattaactcaagatggattaaagatttaaagacatcgaattataaaaatcctagaagaaaacctaggaaatacccttctcaacattaatcttggcaaagaatttttggctaagtctctaaaagcaattgcaacaaaaacgaaaattgatgagtgggacctaattaaagtgttttctccgagcaaaagaaactatcatagagtaaacagacaacctaaagaatggcagaagatattcacacgctaggcacctgacaaagtcctaatatccagaatctatagggaacctaaacaaaactagaagcaaaaacaaataacaccattaaaacatgggcaaagtacatgaatagacacttctcaaaagaaaatatacaggtgaccatcaaacatgaaaaaatactcatcatcactaatcaccagagaaatgaaaatcaaaaccacaatgagctatcatctcacaccagtcagaatggctattatgaaaaagttaagaagaaacagatcctggcaatgttgcagagaaaaggaaacatttatacactgttggtgagaatgtagattagttcagccactgtggtaagcagctatttctcaaagaacttaaaaacagagctgcattagacccatcaatcccattactgagtatatattcaaaggaaaataaatcattataccaaaaaccacatgcacttgtataatcatcactgcactattcacaataacaaaaatatgaaatcaagtgaggtgtccatcaacaatggattggataaagaaaatgtgttacatatgcaccatggactactacacagccataaaaaataataaaatcatgtccttcacagccacatggatggagctggaggccataatcctaagccaattaacacagaaacagaaaatgtgtattcacatttataagtgggagctaaacattgagcacacatggacataaacatgggaaaaacagatgctgcggactagtagatggaggaacggagaaagcatgggttgaaaaactacctattgggtactcttctcactacctgtatgtaatatacccatgtaataaatctgcacatgtatctcctgtatctaaagtagaagtttaattttgaaaaaaataaaataaaaacataattgtaatgcacacaaagaaaatacacatgtgaaatacttatatgatcaatattgacagaattggtaaggttgtaaagatgcttccaggaacatttgaggaactgtaaatttatagaaatttaaaaaatgtgagaataagatcactagattagatggagaacagaataagcctctactagggcaacaaaatcataatctttggagtcaacttttcttttttattttatcagttttattatttgtaaagtctacacttggtgaatcaaagtgaaaaaagacaactccaatgtacaagacaatattaaactatgtttacagatgctaaagaaattcagagaaagggagagattttatgggttaaaatggagtcaacatttcttctggaaagaaatatacaagttaacatttaactttgcaccttctaggaaataatcaattagaagaaggcaaagcaaaagcagatatattgttctagagaattaaatactccttagtaggactattaaaatatggccagagtgacaatgaaagaacattctgtactctttttgccttattttaaaagtttggataatctttcttaacacttcatgccaaattaatatctgtttccactctatttagggatacacctaaatgttaactgtcatctttgaaaaaaggtgatattaaaattcatcagaccataccttatatatcatttacaccttgcttaagatattaaaatacaatgcagtcaaacgttggaaatcctagcattttaaaaatatatatattttgaattattgctctcttctgatgcagtttgataaactgaaagcaactatgagttcatcaacatggtatatagcatctatactaaaaaggctatatcacattgcaattgattactaggtttcaccaatctttcccaaggtaattttaagatgcctaaaggacatacttatttcatattcaagaaataaattacaagatttaaaacatcaagatatgaaactgatatgtgccactaatcctctaattttctaacgctgtttattcctgtaacatataaatattttgtgcactttcttttataatgatttttactatatatttgctgaagagcacacattatgctccaaaatttgtcagttcccagatcctattgaacagttctaatctgcttagtttgcactgctgtacctcaaagaattctttcaatatgtatttgaaagtgtttctatctttaaatgtgaaggttttcaaatttcctctactgaaaaattgaatattaaaatatgcaaatatcagtagcatttgtatatctactttcctcggcatttttcttaacaactgaggatcttcttgagctcacagaagacatacgcatacaagcatttggaaaaaagcacttttcattcacttcctctctcacctggggagagaaaatgctgaaggaatataaaattggcaataccagatatttgtttttcctgctctctcttatttaatttccagacttgaatgtctaactttgtagcagaaatttaagtactttctgatgaaattcaagttgcccaacacaaaatttatcatcttctctccatactttttcatttactgaaatagcagtttattttaatatagctgcaacttctatctgcatatatctattacaattgagtccaaattctttttttacagacatgagccattgttgacaacatcctccctcattgtcattaggtgatgatgatcacactaaagttattttattttttataaatttagattttttttctgtcctgtcctttcatatgagcttctcatctagccccaaattctcagatgttttctttttgatagcacagaatttgcaccattgtttagattagattgaagatcattcctggtaaaaatattattaaccgagactaaaaattattaatgctgataccagtgcagccagactacaatgtaagactagaaaataaaataatagcaatacatgccagagaatcttagataaaaatacgtatccctaatatgttttcacatttaagagaaatgcagttttttaaataattttatagttaatcaaattctgtgccatcattttttgctcttgcttaaattatttgctacatttcattctatatagttacacaccaatactgaacacctgctatttactttatttattttattttatttatgtatttatgtatgtatgtatgtatgtatgtatttatttatttattttgagacagagtctcgctttgttgcccaggctggagtgcagtggcgtgatcctggctcactgcaagctccgcctcctgggtttaagcaattctcctgcctcagcctccccagtagctgggattacaggcacgtgccatcacacctggctaatttttgtatttttagtacagacggggtttcaccatcttggtcaggctggtcttgaactcctgacctcatgatccacccccgtcggcctgccaaagtgctgggatacaggcatgagccaccatgcccggccacacctgctatttataactatgtgttttctttgttgctgatgtctctcctgaccctgtaataaaatactatttattaaaacaacctttcagagattttacacctgtgacatcacaaaccttcaacagatgtgaagatatcacatatttgttttttatttatcgatttgttctatctataaaatatacaattctagctttaaatataatttaagaattaagcaaatctgaggcctcaagccttcacaatgataaaatcacacttgaatgaactattaatacttcagttctaaattagaactcattacatagaatgatggcttgagaaatgatagacatccaggatcagataatcgtttgctctaaagagctgcacagttcaagccttttgatatcagcctgcaggatcacagatgacattctccttaccttgtatcctaggattcaactttacagtcagaaacttctaagttaagtcacaatgcgtttatcagttttatttgaatacttagtaatagaactatttttgttatcaaataaatattcactatacatttacagatttattggaatcactcctccccatccagactaaatagagtttttcatagacaaaaatgttcatgttacgaataggaaagcttttccttccttccttccttcctttcttccttccttccttcctccctccctcccttccttccttcctcccttccttccttctttccttccttcctccctcccttcctcccttccttcctcctttccttccttccttctttccttccttcctcccttccttcctcctttccttccttccttcctcctttccttccttccttcctcctttccttccttccttccttccttcctttccttccttccttcctcctttccttccttcctcccttccttcctttccttccttccttccacatttccttgcttcctcccttccttccttctttcattaaaacatccctcccttcctccgttccttcctcctttccttccttccttcctcccttccttcctttccttccttccttcctcctttccttccttcctcctttccttccttcctttccttccttcctcctctcgttccttcctcctttccttccttccttcctcctttccttccttcctcccttccttcctttccttccttccttcctcctttccttccttccttcctcctttccttccttcctcccttccttcctttccttccttccttcctcctttccttccttccttcctcctttccttccctcctcctttccttccttccttccttgcgtccttccttcttccctccctcccttcctctctctcttcctggcttccttcctcccttccttgcttccttccttccttcttctaatgtgtgtactattatttccccttatatttatttaacatctcttttccctcaaacactaactcataataaatattaaccaagtgtttttgaagtaatacaccatttgtattattatttctaccactcacagttaccttaactagaaagctgagccacaccagtttattcttcataatcaaaatgaaaataattatggtatttacattaatatcattttactatcattatcatcatcattatcattatgatcatcatcttttctcagacatctactatgcaattatgtttattgtaattccctcatattttagttcaaaatatattttatattgataaaatattttaaaaccttacagaaaccatctttaggcagtacttcaaaagaaagtaaaatgctttaataggatgtctccaaataacttgaaacttctaattgtaattcatagaactccaatactatgtgcaaattaatgttcaataatgttttttgacagtaatcattgaacacacttttattttcaaagctcatttccaactgtcacttttcagaatgaatttaaccttttcaaagactaaagttaagctatttagagttttcacactatatatcgtgagtttttattattgtattaaaaatgtattttaatacagttaatttttcaaatgataacatcaataacttgggatgcattctaatatgttgcataataagagaaaaaacatttagtgtcaattacgacccaggtactcttgtatatactttacagatattaacttagttaatcctcacaattctttgagttagttactgtcattggtctcattacttaaaacaggagacagaggcatgaagtggataaaaagcctgccaaagataatatacctatgtaattgtggatcaataattcaaatccaggctgtcaaacaatatcgtttatttttttaaccaaactgctaaacatgtataaattacagtaaaaagctatcaccaattgatacaactcagattgtgccttaatctattttttcaagtgcatagtccatttgtgtgagtagactaccttctgtgagattcgctttttaaaaataaatgcatcttcatttttaatttctaagctaaattttgatgactataaaaatataatacaatgagttcatcaaaagatttaagaagaatgctgcaaagtgaacagattggattttccaccccatagatgaaatatctccatcttatcaagtcatttaaataatatgggcatgaggcatactgagaaatagaatgaagcaagtgataagagaggagatcctagggttgcatcaacaataaagaatggcagagagaagaagtttgtgttttcctattgcataaaatctcaatgatcaggcttatgaaaaaacaaaccttcaccagactgtaattctctcaggaggctggggacagaatgagaataaagggatcttaagaagtaaattctaggcttatgcaaaaaaattaaagatgctactataaaagtttctaaggaaatgttatgtaatatcaattaaaggacaggctttcctcgaataactaaatccacaattttatttcatagatcaaaatcgaatatgttccccaatattattgaaaatgatgatatgttttgaactgaattatttgattattgcaactcccgaagtgcaaattcactcttaataagtaatggagaagtcaaagaagtaagctacaaatattcccaccttagaattttgtcttatatttaaaatactacatataacgtctgtagaattgccaccatatataaagcttgcattattaaatttgtcttgtgacaacatattgtctcactgccgatattaaaccaaaacccattaataaaagggaatttaccctatatatttatttatttgtatgccgacataggattcggcacaggaccttgcagagaatgggtgcctgataaatgttgcacagtgtaacgtttagaaacaggcaactttgcaaatagaggctaagaatacatattcattactttgtttctgaaagtaatctgaatgtggaatataatttacactaataaagtttgaatcattcttcatggaaacccctgctgttctaatcaataaagccaacattatgaaagaaaaaaaataaaagatctaggtatgttgactctggtgccaactatatccctaaggatttcttctgtcatttaatctaattatacccagtactcttataatcatattaaaacttttcttaatgaagaaaggagagtaatctacatcttcttactgtttttccaaaaattaaggaagaaaaatagatttaggaatactaagcattcactaagatatctgaataggtgttatgttgttttatgtaacaaccctctaatgattgtatacattttctttatttactgtgctttagatttttatttaatttatattattctttagaaaaacttatatttgtcatgctaagaaaattaccaaccataactttacttttaatcaatattgtttatattttcagaaacaactgaactatccacaggttttttcaataaagcaaggctgaaatccaatcctcaaaagaagcaaattgacactattcatttttatttgtacattcatttattcagttaattacattttcatttttgtcagaagatgttcagaaatcatttgatgtggtcaaagttagcaccagaatctaggattatattatagccacctctctcagaagcagcgatttgtgatttgtccaaaccataagaaagaaagtttctactttaggatgtcaagtatcaaaaaatgaattaatttatctcaattatgctacaataaatgagtcagaagaatacaatatataaacctgagagggaacaaaatttgcaaatgatctctaaaatttcctccatgtcaatctaacaggattgacataccacttcctaccaaaacagacaaatatggaagtacctctggaacctataaccacaaagaaatcagtattatatatatatgtctatatatgtctatatatgtacatatgtacagtatgtctatatatgtgcatatgtagagtatttgtctatatatgtgcatgtgtacagtatatgcctgtatgtgtacatgtatgtacagtatgtctatattatgtatatatggacatatgtacaatatgtccatatatggacatatataccctatgccccttgaatatatgttagtgtgtatatataaatataaatgtgtctatatatagtgtgtacatggatacatatgtatatgtacatatgtacagtatgtctacagtatatgtaatatatgtatttaatacgtattttaatatgcttaattttgtggatcaaaaattacatatgtacagtatgtatatatgtacacatgtacatatgtacaggatatcagtatatgtgtatatacacatatatacatatgtatgtgtctatataggtacatacagacatatgtatgtgtctatataggtacatacagacatatgtatgtgtctatataggtacatacagacatatgtatgtgtctatataggtacatacagacatatgtttgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatacagacatatgtatgtgtctatataggtacatatatacaccatgtccctcaactatatatatttgtgtatacacataattataattacaaatgtgtgtgtctatatatataatatgtatatatatgcacaaattcatgcttagtaaatgacagagaaatcaaagaagctacaaatgttcccactttttctaccttagaattttgtctcatatttaaatactacatataatgcctgtatatatatatatgtatatataaaaatactgtacccctcaacaattatatatatataatagttgttcatagaaatgctgaatagtagtaatatttagctaatctacttaatatgtcaggaattctatcagtacttgattgctaaccctagtcagaaaaaattaccaaggatatttaacagataacaaaagcggcatttagagagatcaaatcacataccttataaggagaagagctagaatctaaatccacgtatatttgccactttttttttttcttaagccattgggaaccaggatgttgacattttacagaccagaaaaatctgattccatatacttccccaaattacaacaagcaacataagattgtgatcttcttattttaaaaagggaattattaatgataaatgtatgagctaccatcaaatatcattgtattttcccaaagtcttatgtttactttctcttactcttgatgaaaatttctgtgttccttccttcctttttttcttcaaaaatttcctcaatatgaactatttgcatgtaaggattagtaaattcctcccttaaaatattcatttgtttgagaatttagataaaaagaaaactgacacattacttactggtataaataattgagtcactgtagttgatgtaaacaacttctgattaaacgccatttattcacggaaccaggtaagatgcagatcaactgagtttaaacatattgctccagttttcctcaaatcttatacatacatatatatatatatatatatatatatatatatatattatactgacagtatacatatatgcatatatgtagctggttacacttatacatgtatatatagatagaaattatgaaattatggcttttagtggactggctacacatggaaatctactacatttagttttcctcaggtaattttgacttttctgacacacaactgttaaaccttttaacactgaatgagtactggatttcttcacgaatcaaatttattttaaatgtccaagagtgaaaaggcacacattaatatatctgaactattcatatttttcaaatgtctgttctccaaaatcttctctaatataaaaccaaaatcagggcataaagatcattacttgttttatcttctgggcataacaagtattaaaatttctgtttattttttccttactgttagggagaagattttcttattttgtatatgatggtgtcgagtatgaattttgttcttccttttataacaacttcatactggataccatcatacacaataaaggggaaaatctgcgcaagcctggttgaaagggtatcacagatgttgaagttttaatctggtgtattttttgtcatcaatacacaggcatgtgtgtgcacatatgcagacacacacagaaacacatacacacatatacaccagattgcctagaacagagagggaaaagaaaactttacacgtaaaggtaaaggaggtcacttttatgcaaggaatgagcaaagctctaacacaataagaagtataaggcagatctcacagcacatgcatcaacaaaccttggaaccagaaaacttaacaggaaaaaaataaaaactcctcaagaaacactttataggtagtatacttttttaaagtgtatcttcaaagaaatgccttttagaactccctaaatatgctctagctggacttgcttacaaccacaagaggcaaaaggggtccaaggaatcaaatgaatcactaaagaagactactgtgctgtaagtaccacagaaccaaaatatttagtctgtctaaatctgtgtcactcaagtcactacaattggctcaaagataagaatttcaactaatatggaaaaataatgaagatgctcagttcctttttttttttttttagatggagtctcactctgtcgctctgtttctgaggctggaatgcagtggtagcatcttggttcactgcaacctccgcctcccgggtacaagtgattctccttcctcagcctccctagtagctgggattacaggtgcacgctgccacacctggctaatttttgtatttttagtagagacagggtttcaccatgttggccagactggtttcaaactcctgacctcaggtgatccgcccgcctcagcctccctagtagctgggattacaggcgcacgctgccacacctggctaatttttgtatttttagtagagacagggtttcaccatgttggccagactggtttcaaactcctgacctcaggtgatccgcccgcctcagcctcccaaagtgctgggattacaggcaccagccactgtgcccagccaagatgctcagttcttaagatttaatttcatctatcagaagaagtagaataaatatacaagaaatttaaaaacaattattgagaatcttttaaaaatatttttttttcagttgggttatgtaagatttttatctgtctccctcaccttcttattgtaacctatcacttcctatccaacatttaatactttatcatactggaagggaatggaagtgatgcactgggacatatgaaaagtttacagaaattttttcaacttaattaataaaataaatgcctataaagagaaaagtcaatgatgttatttcttcaggcaaagttttcacagatggcactgaataattatttttaattctgaatgtaaagatatacaagatgcgacatgttacttacctcagcaagcaaagtgataaacccacaacatttttattaaaattatatatagaaacaacactggttttgatatggaagaaaaatgtaaatagagggaaaaacatgtacaattgatcttaacaaaataaaaaacattattttctcataattgatatttccgactgttgctggtaatacttttcctgatatgagttagtgaaagaatacaaataatacagtatattagttgtacagatactatttctcattgtaaggtttgatgaataattacaaatttatagaaaatggaagatgcacttcagtgctgtttttaacgagtatatataatatctgctctgaattattaactttattataaattatatattattgagtgtcatttattattttctgtcttaaagtgtttacagggggcaaatgtaaattcaaaacagttttgactatatatgttataaagctagaggttttatttaccaatataacacaacagcaaatagacgatctgagtatgttattgttctcagcttccctttaggttaggataccggcaagcttcctcagactggatactatgcagatggttaagggagacatagttttatctgcttacttgttcaattatttgtctatttttactgatagccttacttgaactcccatcttgttctcgaaatagtactagtcactagaatacagcagaagtcctctgaggctcagatgaacagacggaattagaataacaagaaaatttttgggagaaacaacagggaaagatgaaggggaaaggaagcaggaggcagcaggagctttcagtccatgaggcaggtctgatacctgtgaaagaataagggaaaagaagggaaatagaataggaaaagaatccgaaagtagtgtagttctgaaaagaaaaaaaaaatctcagaaagtctgataaggagattcagaacaaagaatacccattagaggagttttgctcaggcaggaatggcctggctctagtacccactgggatcagtcactggcaaggagcagcccggggacgttgatatgggtgctgcagcagatcccgaagttgcagcagctgaaagcttccctttaactaatatgaaggcatatcagagaggatcccctccatggttattacagatatcaatgatacagtttctatgcacaagttcagagtgtggtgagagcatacgataaacaattatatgagaaacatacacacattagagtaagatgctgtgaggacccaagaaagggatgtgtaactcaggtgaaagagaggtaattgttctgacatggcatattggatctgagtaaggcaggatgagacagagatatccagattaacaaaggagagggaaaagctttggcagcaccaatagtctacataaaggctgcaacacatagagagcaaggtgagtaaggtgagtgctattaatcacaaattgttttcaattctgtatggctaaagtaaaaaaaacaaacaaaaaaacattaaacatggccacaaatatggatctcttccactgagataagtagcctaattttcctcactttaaagatggactggccttaccaatttctttgaccactagaaggcaggtggtgtggcattatggaatttttgaagctaggctataaaaatcattacaagttcatctagctctcttaaaatgttcactctgagggaagccagtcaccttgtgtgtaggaggggtcctgctaccttgatatcactctgcagtgaggaagcccaggctaacaatgcagggaggtggtgtgtgtgtctgtgtgtgtgtgtgagagagagagagagagagagagagagagagagagagagagacagggacagagaaacagagagctgacgaggcctagatattccagccatcccagtttacatgccagagttgagaagccattctggtcattctagggccaggctcacatgaaaaagaatgaaaaatccagatgaaagtcagactgggagatatgaattatttcagctttctccacctatttgagacaccttacctgagactctggtcatcatggagcagaaacgaactgctcctgccaaaccctctctaaatgcctaatgcacacacacacacacacacacacacacacacacacacacacacaaacatgatcctaatgaacagtgttattttatgtcataaagttttggagtggtttgttacacgccaatatataacaaacagacataatggcaagaagaaaatgtctaagaggtcacctgagggtatactgtaaatgccttgtttcaatcccaaggaatttgagttctatatggaaagcaatgcagagctatgaaaggataaacttaagtatgactgagtctgaaatgtaaatctgaaaggtcactctctagataatccacaaataatggattagaaataagtgaaccttgaaagggagattactcaggaggcagttcttgtggtcatgcttattctgtgacattcagcataaagctgagtgtcagctggaaaacagaaatcaagtttaaaaccctctgccttcaaaaagcatacactttagcaacagtacacagaaagtcttttccatgagtactttctgcacagcaaaggaagttttaagggtcaggagataagataaaatgtaccatgggaagtgaaaggaggagagagagtagggaactgtgaagtctttgaataagaaagaattcaggaagtaagggttgaagaatatatagaaaaatgacagctgaagttagagtagcattaaaaatggaaggtttgagtaaaagagataaagtgctttaaaaaagatgatggtttagaaaacaaaagaataattttagtattttaacctgtttaacacattttattagaaaaagattagtaccaaagcagccacaaatgaaataaaaatatattaacataacattggataacacacatttcaatcatcttgttttcattttaaaatataaccaaacatagctacaattcagtctactgaagaattgacatatctaattagggaagaagagggttttttttgtttgtttgtttgttttttcccccccagcaaatgttcaaattattcatattcctgtttttctgtgcttaaattactaaaatatattctctaataatattaacaataaatagaagttcaaatcattttcagatgaaagttaatttaacattgattacttacagcccgttacacatgttaaaattattatagaaaacaaaataatatgagtatgcttacaacattcagtacaacaaaattaaaaactccaagatgatgggtatgcatcaattgaacatcacagtatattttctttttaacaaggctctgtgtcagcattatgcatctagcagggtgaatcttaggtaggaagttgaagttggacaccaccaacagcacagggaaagataatgagggagggagaaacaaagagtgataaatgaggtgggctaaaagtagaagtttccattcttttatttattttcctttgcctttcaatttaggttattcggttgtctttggctgatgcactgacttttcaatgtttctcctaatgacttgaaattgacataggaagagaacatgtttcctgccttaagtctctaaacagattgagtagggacttaggtcctgttttgtcactaatgttgtcagtagaggaaatagtgggaaacaaaggcaactgttgtgttctctatcattgtcaattggtacgacaaatagaggagaaaagactagaggggagatagtgggaaatcctacgcctcacgcatgtgtttctgtgagtgttgggggtgtgtgtgtgcgcatgcgtgcattttagtgaactttgtattttttccctttctctaagactcaatgattttgtattttcacccatcttctctttgaggcctggcccattatattgctatgtacaaattcatatctattttatttttcttgttttatacatgtcaatctttttcttactcttcatgtcttgtgcaatgtctggtacttatgacagaatagggggagaggaaaattactgcacaaataaatgcatgtcttcttatctattgtattcttctaatcaaagttttatatttctatcctttattcatctactttagtgttgtaaaaatgatgggtggtgaaacttactctgttatctctcatttaaggagatgttactgatatattaataaaaagctaggattcttttctcttcataaaatcaatcatcattatgacttgtcctagggacaataagagatttgtggtttcactgaaaatgactacactgcctaggagtatgagtcatagtatggactccgtgttcttatagaatacagcctcagtaaggcaagcatgcccttgagcacgaaggtctgtgaaaaacagcttggaacactggaagcaagtattaattgtattgccaagtgtctaaatgtatatgttcattttaaatagacttactattatttcacatttttaaaagacaaaatattttgctctattatttaaattagaagcaaaaggaatctttaattaatgatttcactaaatctgttctcaatgaagaagaaatatacatccactgtatatttcaagaataaaacaagaacaaagaggcttaaaagaaaaatgttacccataactccttggaaatatttgccatccttgtaatcttaccttcttctacttcaaacatttcaagaacaattgcccctcccaaaatatataccttgatgtccggttttgtaaatatgataataaaaaagacagatgaacttccttccaatatttgagtcaaaatattttgtaatgaattctattctgttttccctagaggagtacgttaaattataatgtctaggcatactttgagggaagaaaaatcctggcacaaatcttatttctgaagcaaagaaatacaaaataataggcacatacttaatatttgagacaccacagtacaccacccacaggtgattgttaatacataagagaattacttattatactaagaatagtgtcactgcagggtaaaatatcaaaatttctctctttgtcttgtaaggctattatgaaaatagaagctatctgtagtaggtagtagttttaacctcaagatttttaattcataaaactgaatcacactgctaaatttaattcagctgctaattccttattctttcagttactgttgacaatagcaattttatggttacctaatctagtttacaattacatgcattctatgtgaaggcttttaagacaggttatatagaatccattacaatattcttcaatagcaggaaagtataaataatctttcagtctggtaataagaaatgtatttattctataagtagtaatttgtcaatttgaggaaaaaacatgtaacatttgaaatcagcttgtcaaaaatatttaatgatgtgtttcccaaaaaagttggcaatattgaaatgtgagtaaagtagattacaaaacaaattaacctcaatttgtggatataataaaaggatatatgaatagaggaaggactctaagaatacacattttcaatataactgtagtaacttctgagagctattactgtggttgattttaattattatttataatttttagtattttaaaattgcatgtaatgagtatgtacatattgcgaaatcaaagaggaataatgtgactttaaaagctattcataaatgttgaatttgagctaaatttgtccttttaatttgaaaattcttggcagtaacaaaatgtccactttccctttacttgtctaagtgtaaaatttagcattattttttctttattcttccaatatctgaaggttttccgtatttaaataacacatctaaactctcgctaaaaagacaagtgaaaaaacaaaaagtatccatatgcaaaaacactgaattgcacagcaaatttatttattgctttcttacatctctattattcatactgcgtagtcagacttattcaaggaaggcttaaatgctttaaaatatcaaataaaatattgccttctggaattactcatattaatttcaaacttcctttaatataacaatatatcaattttttctaatcatttaatagagtagatttgggagatttcacttctacattccatgtgattgaggataatgttttcatattctttattattgtgaacagattttcaaaatttcttaaaatagaaactcaaatgaaagtataatctttaaataaatcttaaaggtactgccagtatttttgcaatgataaaatctattattttcttgtgggttaatactaaagccacattattagtactagctgtgctatgtgaggtaataataaagctgttattataaatataaatatttcactataattgtaacctcaattcctatctttgtgttcccaaatcaaaagctaagaatacttttagaacaagtagttaattagcacttcataatttgaaaaaatatacagttgttacagtcaacattttattggtagagaaaatgattatggttttgaatgcattcttttaaatttagtgagtgaattccaattcaaaatatactttgaaaatattaactaatgcatgacttacaaatattataaaacataatggcttttattataaactattataaatatatgtactaaaagagaaaaagtaagcaaatcattttttgccccataaatgtgattttgttttcttaaaatgcagggaatactaaacaacgtttacattttagaaataatttaaacttaaatatgttaatccatgtaatcttgtgaagaattacatcagtcactttggttatttaattaaaagcccattagggaaagaaacaaaacaaaaagataaacaacaaagtgagatacattaattgacttacacagagtacacatgaaagtttttataagttttaattatataaatatctctcaatttttcttaaattgctgatttcataaattaagtagagataatcattgaccacagaataagtgatggttagattctttcagcaacataatttcatttactcttttctaccgctaggttaataaaaaaaaaaaaaacatgaaatccaaattcatgttattttgtgtggttcacctctggatttctgattctcaaagtacgcaaagcaaatgtgaagcattccataaatagctgaattattgagtaaatgtaattcctaaattttcattaaacataaactttctatgtaatccagtaattaaaataaatcattattactcactaaaggctttaaaatagtatgctaaccctgaacaaagtggtgttttttattctttaaacaaaaacttattcatcataaaaacattaaaaatactatttttaatgaatattcattgtcattttggcacattccttccaatttctgtcctgtgtagtatctaacacagaggttgcaaggagactctgaatttgactttctcagcctgaatttttgtcctcttgttcattagctgtgagaacaaggatcagtaacataaaccctgtatcttaaatttttttgtctcaaaaattaagctaaaacttttaactacattacaggactattataggattacatgagttaactaatatgatgagtatgtagttgagagtctgttacaaactaagtgatcaatatatataagttctgcataattaagatgattatggtgataatgacgatgctgatatctatacgtccttaaagaacctgactataaaaggcactgaaaaatagactcaatttggaaatgttaaatataagtttttaatttgtctaggaagaaccagaaccaagttttaacatgtagttcatacaaaatactacctaaattcttctggggttcacaattaaggttgtactctgtactcaggaaaatgtttatgtccataacaaaagatatgtaaaacttgtgcttgttcccactacctctgtccagcccaaagaactttttcaattcctgttcaaaaccagtgatctaataattctgaagcaatattcaagaagactggcatacattctccagtgccacatttgcattaggaagctgcaacattttctagtctcaatttctcaacctttaaattaggcataactctatttttcttcgtttttgaaggtatggaagaatagatgataagatgtgtaaaaatagtctagaaaggttttttaaatttattaatagactatattgatagtttaagatttacagacaacttgagcataaattacagagatctcatattcttttccactcagtttcccctgtcattgacatcttaccttagtgaggtacaattattacaattaatgaaccaatattgacattattacagttgaactttcaacaacttgagttaggactgtgcagggtcactcctatgaagacattttttaatcaaacacggatcgaaaatacagcttttgtgggatgcaaaacccacacatatggggggccaaatattcctatatgttgcttctgaaagaatgtatgcaggacttcagtttatgtggatttgggtattagtgcaggtggtcatgcaaccaaaccctgtgtaaaatgagggacaaccatattaactaaagtccatagttaattttgatttccttagtttctacctaatgtccttttatgttctagtatttcatccaaaataccacttaaaatttagttgttttatgtccttaagctcttcttggcattcctctttttgatgatatagacagttgtgaggcatactggccaggtatgttatagcatgcctctaaactgatatttgtctcatgttttacccctgaaaagggtttatgggtttgggaaagtctagaaaagttaattagaagatatcaattacttcttccttactatttgaagaaaatcagtatttccataattaataaagtaattttctgttttgaagacattttaaaatgatacattaaaacaatctttgggatcatagaagctatttctaaaccaattaaaattattaccagtaactactattttaagaaatcactctatgctgagtgtttcaagtccacttaatcctcacaatgattaaaaaagatagatcagcttatccctatcttcaaagcagatgaaaaaatgggctcttcaattatataattttcccttgttcaaaagctcatcagtagagctgagccctaaagctgcttacttctgatttcaactacatcacccagtattttcaatataagaaagccgttttattttctctcaaagttcttctgcttctccaatacttaaaaattcatttaatcctgcatttatacggatatctttcccagctaatgggcaatggttatgtggtgtagttttcctcctggataaatgttttattattctctagagatgcctcttctcaatttttgacttaaagaaggagaaacaagtaagtgaagaccacttattttacacggactagatttaaaattaattattaaggagaaatgtaactatagatgtagaaaatatcctatctttgaacttctgcaatctttgaatgacatgttagaagtaatgagggtgcttagtggattttttttccttttaagtgattttaaagtatagtctaaaatgtacatgcatagaaaattaataaaaataatatgaagaacaccagagaatctgccatacagatgatgaataaaattattaaaaacatatttcaatggctctccatagtcgcattatttttcctccccacaatttgcctgacatcatccaaagaaatcacttccagtgtttgttcattatcattcagataccttttttactagttttgctttatacttaatgtattctaaaatatattttttgcatatttcaaacttctttaaataagcttctttaaatgttctaaatctgacactttttctttttctctctctccatatatacacacactatagctctagattattaatttttatttgttgtttataattacaccataatttatttattggcctagtggtgtttataattacaccgttacttatttattgccctagtggtgaacacttaggcttttccaaatttttgataagacatgtaataatgacatgctataatgaaaaatattacacatgtcatctggttttcatagaagacagttgctttgggccctaagatttacattaaagaatggaactcctgggatatctattgctgcatatctttgcctctaccatatattgtgaacctgctcttcaagatgcttatgccaaatcatgctgctaatggaagtggaaaatcctattggtttctgatactatatgcttttccccaaaacttgcaactatgagattgttttaatcttattttttgtagactgggtttaaaagttatttacattgggccaggagtggtggctcacacctgtaatcccagcattttgggaagccaaggtgggctgatcacttaaggtccggagtttgagatcagcctggccaatatggtgaaaccctgtcccgcaaagaaaaaaaaaggtacaaaaattatttggatgtggtggcgcgtgtgcgtgcaatcccagctacttgggaggctgaggcaggagaatcgcttggacccgggaggcaaattatgaagtgagcctagatcgcaccactgtactctatcgtgggagactgtgtctcaaaaacaaaacaaaacaaaaaagttttttacatttttcttaacaactagtaaagttgaatattcaatcataatttattaatcatgtgtatttgtgtatttgctctttattgaatgtgttttcacattgtttgaccaattggcagagggaaggtttcttcaccttattgatttttatgagttctctgtatattctggtgactatctctctgctgcttacattttgtgcaaacacattctttagcattcctgttcacaattgtaccagttttaatatagccaaacttatctatcttttaatgtcttctgcttttaatctgcaatatttagcactaaaatacaaacctagttgcaatatatttttatacatctttgatttgatttgctgaaacatttaagtttattgagtgaacacccataagcagattgatctgtaaacttcttttatcatattttcataacataataagactattagacttgtagagtttgttttagattattcactaatttttacttttctggaaaatattgtgatattaggctatgtgatcagaactggttaccataaactggatttggtcaaaatcaacaagttaaatgtagggctgccattataagccagaagtgaattccattataagccagaagtgatgaattcaagatcatgcagaagtagaatcagagaacacaaataaactgcatgagacgatagcccccttgtcatctctcattatcttactatggcttttgcctcatctcaggctttcattcattagggttaccttatgaccaagtaatggaggtgaaaaaaaaggcccagctagcttaatagatgggtttgcttaatatgggtttcagagtaatgaaggattgctgctatcttaaagccaaatcaatagtgatcccgaaggacagaagtcagaaaaattttccccatggacactcactacttcattcatgttttctgaaaagaggaaagaaccgaggtaagaaaatacactgacatatggaagtggtaaagagtttggaggtttacttagtggtctgggtatacagagattaaaggggagagaaagagcattggggaaaacctatttgatggacttatagaaatatcaataagttatgaagactctttaatctcgtgttaatgctaactaaataatattcaccatggagagggcactagacaaccaagtagataaaatgactatgccaactgacatctgctaacctctgtcattagatggcctagtgctggcataatagatgcctcagtgaagagactgtggtagcagagatggaggctaatccagactccacagcatgggcttctgttcaccagggctgatttctttatagccactgcttattatatattctgacagccacagaaacaaacgctggacacctcacttggcactatagtttgagaggatcaatcactttcttggggacaagttgatgatattgtgatcatcttatttttaaagaagaaataatttgtctggattggaattgactcacatgatgggtatgggtttggtttgcttttatgtctgcaggtgtttagctacaacttctatctaagaccttcagagtgcttgagctgctgaacaagatcctgcgcaatactgcattaactcaaagaactcattttacatctaatttttattttatatgaaagtaattctcagggaattgttttaaaacaactgcagaatattttatttataaaaataatgtataatgcctatgcatacaattagtgtgcattacaaaagtacttatttattagctttatacaatttttaaaccaaacactatacataacattatctagcattgccataaatttgttttaaacttgttaaaatgatacagaatataactcaaatgacctagtaatatcatatgtttctattctcagaatttccccctcacagattcctgaaatgtttttctttccattttacctaccttaaatagaggtagtcttttagtattgcctataatgtatttgttatttttgttgttagcattttaattgaagtgtaatacatgtacagatacgtgaaaaaatattattggtataaataaatcatcacaaagtgaaaacatttatgtaatccccacacaggtaaataaataaataacattaacagttctctagaagtctcccttatgtcacctcccagtgccaactctctatccagactctataaccatagatttcttgtaagcttgcaggtgttataacagtatttcattcctgattatggccctacacttccaccttacatctcacacagcactttgtaaggcacatcacagatgatcaggtaggacaaataccatgtcccaaatagaaccaaatgtataccaatatagtcgatgggcctattattactctaaattaataataaaaaatatcatatagttattcaaacttcacattgaataacagctttttaattttgaaaagaagtgttgtataacaacttttgttacattaatataatcaaaatacagtgtagtagagttttatttttaaagaaggataatatgtagagacaatgataaactattttcaaaagcaaatcatatgtggccattataaatgacaagcactataaggctagctgcggaatattagcatgtcatatgtgagaaatgaataaaatgatgtcatggagaatagtatcggagcattatttactttatcacaagtaaagatagttaataggtttgtttttactagttttaaagtagaccactgatattgaaatgtaaaaattgtgttccatgttaatgcaatacaaataattctcactagaaaaaaaaatcctagagttgaattttcttttttttcatggagaaagttaactgaaccaaaatttctgccagcagaattcagtcttacacatgtagatgtgaaagtgtgcatctcctctcaacacagctttcttcagtaatgacagaatttttcctaataaagaaaaatgtttttcaacatcctgtagagttctctttacataatatttcaaagtaccaaaagactcttacaaacactgtactttccaatgatcactaaaaaggtctccaaatgccaccataggaaaactattaaacaggcagtgattatacgcctagactcatacaacactgtaggccattaaggacaaaccattttccaatgcatttaagagttatattaaaataaattcatgtgaactttctactctcctccttcaaatgtttacagacaaacatgtcgtatcatttgtaaaatggcctgccacatttagaaatttgaattaaatttctgtaataatttaggtccaggaaaaaatgtatagtgattttcccctcagccagtagaggacataatgaaggaaaaaatgcaggaagatggccagaacacaaagcagcacttgatatgcacaatattttacaatccagtattcttagactgggaatgcttgatgttttttccaacattgtgaatggacttatcacacccaataacatccttcatacctttgcacatcaatgaatttggttattttccttctgtcttggttgtccaatagtgattgccttaattgatagtgaattaaaattatctgtggagctttaaaaaatatgttcctgagtaacatactgagaaattctgacccgtaattctatactgaaacttaggaaatcccagatgattatgacaccatatatccaaaagtaagcattttgaaagcactaaaaccttcaacacttatcaaaacacagtgaattgtcatctgtaaatcaattcagtaatgaaaaagagtaatgtcaccatgtaatatcaatgatcttcaaactttctcttttgttgacattgtatttattactcacatttccactttcaagtcctgtgacatatctgcaagctgtattccagtgccattaattaatatatcctttttagccaatgatgttagatttttgggctattaatagataaagactaacatgtaaatataaataagggaaatataacatataaataagggaaacaggaaaataaagagtaacttttgttgcaaaaatttcacaaatgcaagtcaaatttcacaattttattttaagtattaagaaatatgccttctttggtgaaaattattttcaaaacaaattcaataattcatttaagatactctgggaaggttatttagaaatgttctggagacaaaagagaatatatattttaaaaataactcaggtgttatctagggagtaacctgaaaaatactttcacagaacaaaggttaagaaattaatcttcagaaagaaattcaggtaaaagtacatgtctaaaaagacctttgaaaactgggaagttaacaacttttcacatcactaaacattttatataaacttattttattatagccagattagaaacatacaggctacagttttcaaaactagattaatgtgaaacccttggatttttaggaaaattagtctgtttttctactatcacagcaaacaaaactttgtcatcataagtgcttaagaattagctggaatagctagaatgtatttatccaaaagttgtctgtatttaaacttttgaacatgataggacaataaaaattgtttatgaatgataataatattttttcaggtgtcttaactatagtctttgaaagagtacaattccaaaatagtatgatgtgagggctgatgataagatgttcctgttcccaaataggcctcttaatccacttagtacataaatagattacatgaagagagtaccacatgtttgccttaagacaaacatcttacctggtacattttaaaactaagtatttcaaggaaataccagagtaaacctgtggaaagaggagagcagcctgtttttccaagaggccaataactgacacttttcaaatttcttgaatttggattcattttggggagaatagaaaaaagaaagtagcatggttagtaaaataagaaaagaacccaatattattaacagtcataacatttgctagtaatagagactgccccagtttaaaattgatttttcaattaaaatattaaatgtcgttttatgattttttagtctgggaggcaagtcaggagacttttattaatagtcattaactgacaaagcttctacagttgtgctttttatttaatataacacattaaccacagacatcctttgattttctgtcatattttcaattctctgtctgtacacgttgtctcaagagtagcaacatttgtgaatttattttacaattcatgattttgtcagcattttaagggcttactgttccaaggggacattataacaaagcactgaagaacacagaacttcagtttagctggaaatttatattggaataccattgttgtcccttatttactgatttatacactgttcatcagtgaaattgaaataagattagctattttatacagttattataaggatgaattcaattagttttgaaatattggaaatatatgtatttgatataaaaacttgtatatattattttaaaaatatttattcataatagtttaaaacttttgtttagcctaatctaacgtcattttccagaaaataaatgtgaggcatcatgttcagtaaaatgtgtagaatcaaactgactgtataaacccagctttgtcacttagttgagaaatgtgtcgtacatctataaactccagtgtccacgtggcatacctgagcataccaagtccttgctgagatatgtaattaaaagatatgaaatcaatgctcaggagtatgcaggcacccaaacaatagtcattaactatttatgtgatatttagaagttaaaattgaaatgactttgtgagaaatgatacgtgtggggaaaagagaaggatgtataaattttggtttacataactggatagacagtgatgtcattcacggaaacattgtgaaagagtctggtttacagaattctgggaagatgatggaaaagcaagcactggaaatctctttacacataagtaataattacactggcaaaatctctctgatacaactcttttggaattcttgaatttagtgaaacttacaaattccaggagaaagcatggataataaattttagttaatttcagccgttagcttaggagcaactatctatccccaccctcaaccccaagacagggagctgtgcacgtatttctgctgcagcttgcctctagcttgcaaaaactaccatgagcaaaaaggaccacatccttcggttatcaaggatctgtgctgtcatggttgattgctgcttctgagcacaatggtagagacaaaaaggtggtagccattgtttttgcactcccttcttttctaaaacccactcttcctggctaaggtgacttccaggagatttaaaaggctgtttgtccccctacatttttcctttacccctttgagaagtcaaacattaaagaatagtatatttccagagcaactgcatacatgagggaaattagaaagtttcagtgtatcatcaagaaatggtgcaggttcatgaaatactaataaaagtctttaagtttacaactcaggccgatcttcagcacagacacagcctgcaacaatataaacaaaataataacaaaaacagcaagccctggggaagggagaaaatctgatttcaagatttaccatttaattaaattcagatgtccagttttcaacaaataatcacgaggcacacacaggaacaagaaagtatggctcatttaaagaaaacagataaagcaaaatagagtcaccgagaaagacttgatggtagatctactacataaatactttaaaataaccattataatggtgtccaaaaaactaaaggaaagcatacagaaagtcaaggaaacgatgaacaaaatgaaaatatcaatagagacagaaaggctaaaaatgaacaaaaaaaatcaggagctgaaaattaccactgaatgaaaattccataacctatcccccagagaatatataaattattctcatacataaactaaggtagttcattaaccgctataaatgctcaaggaatcctgcagcttaaaataaaaggacattagatagtaactcaaagctatatgaataagtatatatctcagtaaaggtaaacgcatggacaatataaaagctagtattattgtaacattggtttgtaacttcattttttattttccacagacttcaagagactaatatattaaacaattattagtctaaagttcccattattataactttggtttgtacatctacattttgttttatacataatagagaatactaatatatttaaaatgattatgtttttgaatgcacaatgtatagacataattttgtgacattaataactaaaaaaatgtgaatgaagatgttataggagctgagtttttgtatattattgagcttttgctaatatacattcaaattagagtattataattttagagtgttggcggttaatactcatggtacccacaaagaaaataattatagaatatacattaaaaaacgtatgaaaggaatttaaattttcactacaaaatataaattcaatactaaaaaagctacaaggcatctagaaaataaataacaaaatgacagttacagttatcttcttattaacaattactttaattttaaatagcaaagcccttcaaacaaaagactgatactggcagcatggattatggccatgatccaactatatactgtctaaaagagactcactctatatctgaatacacaaacagattgaaagtgaaaggatagaaaaagacgctccatgtaaacagtaaccataagagtactggggtggttatattaataccagataaaatagactttaaataactgttaaaaggctgcaagagtcaaaggaggacataatatattaataaaaggttcaatattccaagaagctataataaatatcaacatgtacataacagactattagaaggaaattttgatataaatgaaggaaaaataaatagttctacaataataattgaagacttcaaaatctacccttagtaatggataaaccaatcagaagataagtaaagaaataaataacaatagaggacttaaaaaacacaataaaccaacaagatgtaagagatatttacagaatattctaccccacaacagaatatgcattcttctcaagtgcacatggaatgttttccaggacggattatgtgttaggccacaaattacatctcaataggtttaaaagatatcatacaaagtatctttgccaactacaacaaaattaagttagaaattagtaacaaaagaaaaagtggaaaaatcaaaaaatatgtggaaattaaacatgtatttctaaattaccaattgatcaaagaagaaataacaggggaactgtacaagtatttcgaaataaatgaaaactaaatcacaacatgccaaaatttatgagacatagaaaaagcagcgctaagagagaaatgtatagctataaatgcttacatttaaaagtaagaaatattttcttttaatttagaaaaagacatatctcaaatcaaccactttacaacttaaaccagaaaaacaaactgaaggcaagaagaagaaagaagataataaagactagagcagagatagacaaaatagatgatagaaaaacaatgaaaccaaaagttggttgtttgaaaagatcaacaacgttagtaaacttttagctagacggactaagagaaaaagaagactcaaattactacaatgagaaatgaaaatggtgactttgctatcaattctacagaaataaaatggactataagagagtactatgaaaacttgtatgcctagaaatctaattacatatgaaatggaaaaattcctagagatataaaacttaccaacactaaataatgataaaattaaaaatgtaaatagactgatacctactaaggagactgaaccactaataaaatatctcctgacaacaaaagccctggacctgatggcatcaccagtgaattcgataaaacatttaaagaactagcatcaatctttttcaaacttttccaaaaatgctgtcatgagggaacatttccaaaactcattctataagacatcattaccctaataccatagacgtatcctttataaacactgatgcaaaaatcctcaaaaaatttctagcaaaacaagttattaagcagcagattaaaatgattacagaccgcaagcaaaagagatttattaatattaatggaaatcaaagatatttcaacatacaaaaattgttaaatgtaatataccatattaacaatgaagggtaagaatcacatggttatctcaattgatgcataaatagcatttggcaaaattttataccctttcgtgatttaaaaaaaacactcaacaaagtagaaatataaggaaaccaccttaacctaataaaaaaattcatatataaaagtcccatataaaacatcatagtcaatcgtgaaaaacttaagagttttccctctgtgataagcaacaaggcaaggaagtctgagcttactactattcaatatagtactaaaagatctggctagaaaaaaatatgaaaggaaaagaaaaataaaaggcataaaattggaaaggaagaagtcaaattatctttgtttacagagaatataatcttatttatagaaaacgctgaaaattccactaaaatagtagaaccaataaattaagtcaccacataaaaatcaagtgcatatctatacaataacaaagaataatccaaaaacaaaattaataaaataatttaatttgcaatagcatcaaaaatataaactatttttatttaaccaagaaaataaaagacctgtcttataaaagctacaaaacattccaaaagaaattaaagaatataaaaatgaatggaaaggcatctcatattcatgattggaagacttaacattgttataatgtcaacaccacagattcaatgcaaatctatagacttaacgcaatccctatcaaaatcccaatgatgccttaaagcagaaatacaaaaaactcatcctaaaattcataggaatttcaagagactccaaatagctaaattgatcctagaaaagaacaagctagagcactcagactcctgatttccaaacttactataaagctacagtaatcaaaacattgtggtactggcataaagacagacatatggaccggtgtaataggaaaggttgcctagaagtaaagtctcacatgtatggtcaaatgattttcaattacggtgtcaagagtattcaatggggaaaaggcagtattttcaataaatgttgcagggaaaattagatatccatatgcaaaataataaagttggatccttacttaacaccatatacaaaaatttagtcaaaatggatccatgacctaaatggaaggcctaaaactataaactcttacaagaaagataagttttaatacttcagatttggcaatattttttaataagacacctgacattcacaaaacaaaattaaaaagaggcaaacgggcttcacaaaaagtaaaaaaaaaaaagaagatgaaataaaaatgcatgcatcaaaagaaaattataactacagtaaaaggcaatttacctaatggaagaaaatatttgcagaacatatatctagtaaaggattaatattcagaatatacagagcactcctaaagctcaataacaaaaaacaagcaacctgattcaaaaatggtcaaaatacttgaatagacatttatccaaagaagatatacaaatggcaaataaacacttgaaaacatgctcaacatcactaatcattaggaaaatgcaaataaaaactacaatgagattattttgtagttcataagcgcgatgactgggtgttcacacacaggtgcaagttgtgccaccctcgaaacttgttacaccgttggcacattacccatcagacatgaaaaaaaaaactacaatgagataccagcccatacccatttaggatggaagctatcaaaataaaacagaaaataataatttggtaagaatggagagaacataaaacccttgtgcactgttagtgggaataaatataaaatggtaaaactgttgtgaaaaataatatggtgaatcatcaaaaattcaacatgaaattaccatatgattctgcaattccatttctaggtatgtacccaatagtttcttaaatatgtattttatacccatgttgttaatagcattactaataatagctaaaatttagaagcaactcaagagtctatcaagagtagaacggataagcaaaatgtggtttttgtatacaacagaatattattcaaccttaagaagggaggaaatgctaatatatgctacaacatgtgtgaaccttgagggcgttatatcaagtaaaataagccactcacagagaggcaaatactctattattcgacttatatgaggtactcagtgtagtcaaaatcctcagaacagacagtgaaataatggttgccaggtgctaatggagggaaaatttttcagttttaaagattgtaagagttctggagattgacaataatgacgactgaacaataatataaatgtgattaatgataattacattatgtgtatttttaccaaaatacaaaattggagaatataaacaaataagaataaataaataaaaaaacaaatcaaacaaaaaccctggcttaaaagaacagaattatgagtttggctttgaacaagctaatttgacatgttatcgggacttccaaaagaggattcaagtatctaatgaaatatagttaatttaatgccacttattgctattgtcattcacagattccacactcagaagttggaacagaaaatgtaattttttgagtcatctgcacagatccttgatcactagggatgctctggagatagaacagcctcacgttattcatcattgagcaaagatacccaggtcttaaagccatgtcctcgctgcatctgtcactgcatgcaggattctgggaggggtaactttgagcaaggcagctgtgtgatgctagttgaaatctctgagagagggaatggtggagagagtggtgttgctgagagcgaaagaatgtttgcagaaagcactccctaatgctgggacaacatgtcctcctttgaagaggcaataaggcgacaaatcactttgtccacaattctagttatgcatcaccacatctaccgtactcccatgtaatatgtttaacttggtccctcctaagctactaatgacctggatctataagatatacatttaagaatgactaccataaatattcatttaaaagaagtatatggtttatggaccatgaagatattaaaattacctatgcaataagatgcttcagtactttcaaaagtatcaaacaagatgtgatagacctttactgcagatggaaatgcagcaagataaacctttagctttccaggtcatatataagcatctgttataagttccctatatttagtgttatgctcatccatactctgtccacttctaggacaacaaagggcaaaaagtgttcatttattcaggtgtggaaaggttaattactcaaaaaataaattttaaaaacaatcaaaacaaacagaaatttccaaattgtatcaaatactcagagaactcatccttgatttttcaaagaattttctaaaaaaaaaaaccagaaacaataatttcaaatgaaacatcatgatgagaatatcttcagaatattttactctgtttctaaggaaatgtgggtgagtcctacattactgaaagtggtcttcgttttctccaaatatgctattttcagaaataagaaaacgtaaagctcagtaaaacactgtaataaaaagtatgatatttaatgtaaactcattcagagtaatcgtgtgaacatggttctatttctgtctatgtctatacatcatcaccctaatgccagtaaatttattttaaactaaatattggtctcctgaggcagaggtaatacaataataataatttagaaaaaaatttacattttaacactgccactttttcataatagtgctatttttccctacataatgcaaaaacacagacaaatccaaaaagcatatttgtgccttaaattggggcaaaatagagcttttttttctcaaacatgggatagtaagaagagctttcatcttaaattcttacagttagttgaattgtttacaccaacattgcatttttataaatagcttctctttgtttcttaaaaatactagaatttcatgttgcattttttgacagctttatcgtctgtaatagtcatgtttagaaaagacctggcaggtgaacaaatacagccaacaagaagtagaaagacaaacattattaagaggtttttgacaatttttacagagaaaaatattttataaaagacaaccctgttcacattttagagctagtcttcataagtgtctaatacaacactggatgattgtaggcatagtttttcacttaagtattaatagaaataatttattactaaaatattcatttatttttaaatttaagttagaaagaagtttgctgctttctgatatgaaattttgaagctcaggaaccaattttttttctttgagaacacatctctgaaattacagtgtcagtcaatgagaaatatggcttgatattcaaagagcataaaatctgatttatatatgacttttaagaatgtcttcttgtataaagtaatatatatttacttattctatgaatgcagtgatttatactatactgcaggatttactatgagatatttatcatatctttgcctatatacataaaggcaaagtggaaaatgttttcaaatgctattgatttccatccagacttaatgaaaagcctgaccttctgaaaacagacttattatcactacttccttattagctgttatacactatttcttctttcaagtgttatcgtctgtttagcttggcattagcaaaggcaataatcattacttttagttgttccccatgttaaaacttttttaaggccactatcataaaagcaatatcaaaagcaaaattccctaaatatagaatatagtttggatgttttctcccctccaaatctcatgttgaactgtgatccccaggtccgttgaaggtgggtcctgttgggaggtgtttggatcatggcaggtggctccctcatgaataccttcgtgccttccctgcagtaatgagttcatgtgagagttggtttttaaagggcctgacacttcaccactcactctcttgctctctcttttgccatgtgatgcacaggctcccactttgcctttcaccatgattggaagtttcctgaggcctcaccaggagcagatactggcactatatttcttatacagcctgtagaactgtgagctaaataaaccccttatctttataaattatgcagtctcaggtattccttacagaaactcaaatggactaacacaatatttttaatggaaagaaatgtgaatggctttatgagcacattagttctcatacaaatacaaaacatatagcttaaatatgaaaaaagtaataagtaaatatcattattaataggtaataatttaagaattccacagtgaagaactccttcattacacatcaatgtgtaccataggaaccacagataaggtggcaactagaacaaatctcttcaaattagtaactaatctttcaaaatctgttattaggtaaaaatataataattgtatttcaagtattacattgactttgcttagattaaaatcacacatatgagacaactgcataatctgaaatataaatttagggagaatgagctacaaataaacactaagatagtgagaaagatagtagggaattggacaaagatattccagtttatacaagcctgagattaagtatgccaacttgccttagattcttgaaatttatactttatcatcgtatgcactgtatctttgcaaagcaataaaagtgtgtaaggaaccaagaatgacataagtctgctaggatattttttatatgccacgtgtcttgctataaacttccttcaaataattctgattgtaacaaaaatatcattttaattgttttcaatattttatgaagttgtaaaatattcccaaggaatgattatcagacaaatacttggctctgtgctctctttagagcagttttccaccttgggaaactgcttttgagatcagcaaaataaaactgctgatatttttagagcccatacagtaatgtttagagaagttttctggtttctttttggatacaggtaccccagaattatttaaagtaatattcataaaaggactgacttatgatatttaatataaaatgaaagtaatttatattagagtatataaagtatagtgaatattcaaaaagctccaatacattctgtctccttcacacttgtttttagttctgaaactaatacaaggatttagaaaataggactttatgcaatataaaccacctagctagtatattaatatattataatttttaaatattaattattaaaaattatttactgccttcattatgccaagcactcttctaagcactgaagaaatgcaatgatcaaaacacatacaattatgctatcttggaatttacagtccatgaggagtaagtgaggagagataaacaataaacgaggaaacaagcaaatacagaatatgtcatgtacggattttggttgtgatgaaatataaatcacgtaaggaaggaaatggtggtgcaggtgttgagggcaatatttcagatgctatgagaaaacaggtctctctgtgaaggtttcatttcagcagagagctgaatgaaatcaaggtaaaaggcatgctgatcattagggaacagagtgttcgtgtaaagtgcaataatgaaattgaaaaggtctaacttgatgtggtttggggtacccgaagagcagcaagatgactagtatggctgaagcaaagaagcaatgcatggtagaaaattatctcagagaggtcactagaacaaatacactgatctgtttgcagtgaattgattcttaaaattttagtaattatgatgttatatttactctattagacaatgtgacaagaagaatggatcattaaagaggcataagtggaaaacacctgtttcaagatatgtagtgctatgataacaccaagggaatacatttgaaagcattagtttgcagctgcagatgtaatgagtttctctaatattacttctttgtaagtgaaaaggagctgagaaaattagatgacaaaaattctaaaaatgttaaagcaacaaaggtaaatgtaattagatgtgaggaatgttcaactgccaactggcagtatagctgtacttgaaagaaattgatggaccatctaacagttctagtcccttatattccagcagccacttcctgaaaaaatattcagttgggaagaaagttagataccaggatctgtctttcaagatgaagcttcttgaaacttcttctctcaacattgtagtttaaacggaagtttgaaataattacaagttttcaataattctactacatttctttattgtatattagggaattctgtcatttgcaacaacacagattccatcaaattttatgatctcattgaaaagctgctatatttgaaaataatcaaatgtaaaagtctatttcaaagcttttgacattttaactgtttatcaaaagaaaattcgaattagtaataattttcagattcaatatcaaattatgtaataactcagcatatacttcacactaagccaataaggtatgcttactgttttgatgtgtttttatttgatggcatatcctgctagactcaaagtctgacccattttctgtgtaaaacaatgtatggtctatgatgtttccatttcttatctgaaagcaatgatttgtaacattgctttatttattgtatattattataacgtttcttttaaatatattaatatataagctaatattcatgttaccaccattaaatgaaaaacatgctaggtcatagtgtggtatccttattaatataacataatatttctgtaaaatttgaaatttattcttggttttattgtcacaaaaaaaccacaatgaagaatgaaacaactgctttcagagccaatatattcatccaacattttcactctaagacccaatcaacattctttggtctttaaatgttaatgtgtgcactgtcaaatgattccttagtcatgagttttagcaagttataactggatagttttctctattacagaacttttttgagtctgacataccatatatacaatatgacaatgaaatagtggtaattcgtaggtttctctgaatgaacatatttctatgtccttgaaacactattccatggagcagagcatgggaaaagatgtttctgtaccacaatttctagagaccaggacatagatcttagtatcctaacctcttccctcttagagccttcctttcacagagtaggcaatcaactttagaactatcaatgaatatcacaaaacaatgtcagagtattgctttccaagcctcctgctattggcaacatgaaggataatgtaggtaggcagtggggaatattttattttcccctttataatctgaaatctactagtggacagcaaatatataaaatttttaaacttggaatcaagtcacaccttagtttcagggtgccaattatcacaaactgtaaaactctatacttttaatgagaaaagaaagaaaaatatggtgatagtatttttgacagaaccaacaatataatagacaataaagattttatgtccctgagtcaaatgcagctgctgcaagaacctgaaaactctatgagggtggatattatactaaggaaacctggggaggataatagtttatctatcttcttattgttatatttctggctccctttataggacctcattaataatagacttttagtaacatctcttgatggttgaacctagaaaatgtatgattattttcaacatagttatctctatatatactttcaaataggaagcaaagtagtaataaagtgtataattccttcaaattatttcaactcagagcttttactcacaaaaatcagagctcttccttggctctcttatttgacctctggtcctaaggattgcagtggaagcagttaacctccatctataacacatgatctgaatcagtttagtaatattgatttctgtaacttcccacttattaatatataaaagtgttatagtcacattggtccaaatttgacatttccagaatacttccagtttttggttaatatgtcaaatttgtaatcttataaggacttaaggcccatccttacaatcagaggtaaaaaaagacaaataatgttttcatagaaaaccgtgcagattcagttattgccagaaaatacccaacacataaaattttgccaaataaaagtgtatgttttttcaaaagtctattttccaatgtttgaggtggggacaatagacttggtagccaaatgataccattaattcaaccccatactggaaaacaacaaaaaataatttttagagaaaacttatgtccttagtttgtaacgaagtgtctataaaagactagtctttcagagtagatttatttctaattgaaaagctaaattatcaacaaatgttaacattttataagtggtaattgccacttactatttagttgtcaaatgtgcatgtccgcagtgcattcctctccaagatgctattgtcattttctgaaagtaccaaaaacacattgcactttaatactgttagacacttggaggaaattcacgaacaattccctttggactagcaatgaaataccacacttgaatatcagccttacttcttcaaggtacttagaaaaggtcattcattcagaaagaacaaaaccaaataaagttagatactctctgagaggaggcttgctttgatagttgtattcacatctttaccaattaacatgctctagaatggggcatccacgtgtggtatgcttcacgatgaaccgttcactttcactctattcaccacctcactgaatactcttagtttatttgagttgaatattcagttgactcttgaacaacgtgggggttgctgcctattgtgcagtccaaaatttgcatataacttttgactcccccgaaatttaactgctactagcagttaatagataatagttgactggaagtcggtgataacatagtgaattaacaaatatttttcatatcatatgtattattaatatataccatattattaaaggttagaaaatgttactaagtaaatcataaggaagagaataatgtatgtgctgataattaagtgtaagtggatcatcataagggtcttcgcccttgtcatcttcacactgagcaggctgaggagaaagaggaagggctggtctttctgtttcatgggtggcagaggtgaaagaaaatccacacataagtagactcattcagtttgaactcgtattgtttaagggtcaactgtattacactttgtgataaggataatgtgtgttgcatgtttgatgtaatgctacatggaaatgaatactcccaaatggggtaatggtcaaattttctgaaggatttgtagcaagattaataaatttcatccatccacaaaatgtttttagtttcaaatcaatatgaaccattagaaaaaagtagatgtgcttgatgattaaatgaattttgtaataaactttcatttatataccaaaaccaaaataacagatatctaaaaaaaaaatgcctaaaatgaaaacatagagttggacaaaatagtgaaagcaataatatttacctgtttaactaaaattctattaaaacatgagttatttgcatctcatctccaaaacaaaaataatttctcaaattcattgtaatgtcaaactatgtatgtgggtacatgctttgaagtataatatattttactacaaaaattcaaaattgtttaagaagtgttttgaggccaggcatggtgactcatgcctgtaatcccagcactttgggaggctgaggcaggtggatcacaaggtcaggagtttgagaccagcatggccaatatggtgaaaccctgtctctgctaaaaatacaaaaattagctgggcctggtgttgcacgcctgtagtcccagctactcgggaggctgaggcagaaaaattatttgaacccaggggtgcagaggttgcagtgagccaagattgcaccactgcactctagcctgggtgacagagtgactccatctcaaaacaaaacaaaaaggaaacaaaagagaagtgatttgaattcatatttaaacttggccaaaatttattttcagattttatttgtacatacacaaacatataaaggtttagaaaaatttttagatctttacatttatgcagttgttatataactaatgtcaattttaatattatactaaattctgtggagatacctgaagaaaaagaaagaataattattttaagtcaactatgtatttatactacaactatttattccagccctaccctccagaacttattagtttacttaaaatcatgtaaattattatcagtaactattttgaagactttttatggcattgttttatataaaaacgaaaaacactgttcttatgggtaaccaccatattcctggtaaaagacaaaaaataaaatatattgaaaattgaaaagagtcagttaacactggtttcaacagaaattaattttggagataaagtctaatgttaaattcaccttggtgatcaatccacacaacctatggctaacagcattcttaaatgtgaattcagttgttaatttgctgacatcttttatataaaaaaataagaatcataatgaatcttttcacagtagtaaattaaatgatttgaatttctgaacccttcagaaaggagaaatttaacttttaaaacgtccatcttttaattaagaaaggttaaagttaggagagagagagagagagcaactgttacttttccagtccctggatttaaccataacaattgaaagtgaaaaatttctaaaagtttctaaaatttgtttaaccttaagaaccaaaacaggtaaggttaatatacccatggctttaaaaaaattacaaatacttctgaatgttttaaattgcctctttgtctaattaagccaggttgaaagttcaaattaactgaaacacaggattattttatattttattttatttatcttattttattttattttattatttttttgagacggagtctcactctatcacccaggctgaagtgcagtggcgcgaattcagctcactgcaatctccacctcctgggttcaagtgattctcctgcctcagcctcctgagtagctgggattacaggcgcctgccaccaagcctggctaattgtttttgtatttttagtagagatggggtttcaccatgttagccaggatggtctcgatctgctgacctcacgatgcgcccgcctccgccttccaaagtgctgggattacaggcataagccactgcgcccggcctgaaacacagtattttaaagtgataattcccaatgtgtcattcattatatttagctgaattataccaaccgcactttcattgacgttgattttagttttaattcaatgtgtgtattagttcgttctcacactgctaataaagatatactcgagactgggtaatttataaaggaaagaggtctaattgactcacaattccacatggctggggagtcctcacaatcatgttggaaggggaagggggagcaaagtcacatctaacatggtggcaggcaaaaaagatagtgtgcaggggaattctcatttataaaaccatcagatctcgtgagacttattcactatcatgagaacagcagggggaagatccacccccctatgattcaattacctcccacgggttccctcccatagcatgtgggatttatgggagctacaattcaagatgagatttgggtggagacacagccaaaccttatcaatgtgaaaatagaagaatatgcacaagctcttgatgttagttctccattttaagcatgtttattttttcaaacttttgtggttttggaacaaaagagaattgttaatacttgttaatttaataacaattttttatatagcatatgtgaactatagttactgaatttagaatttcaaaagaaacagtaaattacacagaaatatctgattgtattactatcacaaatctccaattcgaaatacttttagatgagtaacaatataaaagtactataaatgtactttagacgtttcagtagctagatgacacaattatcatagaagtgagggtttttaaatgatttcaaaagcattattagtgtaacgcttcaaacatcagctccttcagggagtaattcctgattagttccatactctcccttggatcacctacttgtacaactcatctctgtaactgtccttaactactcatctctgtaactgtccttagctaaaatttttatatgatttctttaagtgactttctgttcctcaagattctaactagacactgtcttatgttttttctaagcaactttgttgtatgaagtggcaaaattaggtattatggaaggaagcaaaaatatatgtagctaatattactggatgattaagatctcagaaaaaaaagatgtcaaaaatatttatgatcatggcagcaaacattatgctaggaattgtaatcaatattaaccaatgtccctttgccctcaccctccactcttattcatccattcactcatagattacttgagcaacgtattgggattttttggtttttttgtttgttatgttttttatttgttttttgttgtttttgttttttgttttttgtttttgagaaagagtttcgctcttgttgtccaggctggagtgcaatggcgcaatctcagctcactgcaacctctgcctcctgggttcaagcaattctcatgcctaaacctcccgagtagctgggattataggcacctgccaccacgcctggctaacttttgtatttttagtagagacagggtttcagcatgtaggccaagctggtctccaacacctgacctcaggtgatccacccgcctcggcctcccaaagtgctgggattacaggcgtgagccactgtgcccggccacatattgttgttttatatgcacacacgtgaatttatataaataacattttgttatatacttcattttcttaactattttcactacacactatgttttaagacctatatgtttttctgtgtattcattattcatataactcacccatatccaatggcttctaaatatatggctatatggcttcttcattttttttatttttttatttttttttttttttgagacgaagtctcattctgttgcccaggctggagttaagtgacatgatctcggctcactgcaacctctgcctcctgggttcaagcaattctcctgcctcagcctctcgagcagctgggattacaggtgcccaccaccatgcacagctaatttttgtatttttagtagagacgggggtttgccatgttggccaggctggtctggtctcaaacgcctgacctcagatgatctgcccacctcggcctcccaaagtgctgggattacaggcatgagccacagcgcccggccattacgatggcttttacctgaaaaatcctcaagtgttcatacacatctatgaaacaaaatctatttctaatctaataggaaaaatggctcatttctcaccaccttccattgcctctagccgatgttcttctattcagcatcagactgcatcttcacaggctattgtcctgaggaatgttgtactggaagctggtggctgatttagtataggccatacattgttgaagttcatgaaccatcacagatggaaaactcaaatttccatcaagaaagaggaaatagttctccccctttttccttttcctctatgtgaaaaccacaatgagatacgttgcttatccaattctctgaagatgcaacttaatcaggagtcagtgattcctttggaatccaaaaatgtactaaaattttatacaatattttgaatgtacataatacgcatttttgcctaattgtcattgaatctttaccctatggccatatatagagtcagcagtgcttttaggaaagtaaacatacaggagacttttttaaatgtttagtttatgacttggtactgtgtgaaataatcaaggacaaaatatttccaaaactaaactaatttttgaactaagtaatagcaaaaatagaaaataaataaaatatataacagaaaatgctaatattcagaaaaatatgcatttataactggatatctatttagattgaaaatgtttaattttcattgaaacattgaaaatgtttaattttcaatctaaatagatatccagttataaatgcatttcaactgctgactacctaagtatgaaggaggtctatttgctctgttttttttaaatgtaaattttgcttctatcttagcatgttgcttttcttttctgcacataagtgcaaatattttcaatagtggactgcatcacatatatcccaaaaatacgtgaaatgattatgagtcaatttaaaatctctgaaaattaaaacttaattttagttccttgatgtattaaggtatattaataaaagataaaagtagaagacatttattagacaactgtctgaaggacctggtatatggacttctgcataaaaagactgaaggtccagtaattaaataagaaatccactaaagtctaacacacacatacatgcgtgcacacacacactgttacacatgtgggcaatttttttttggaaggaggcatggggaaccgattcttgctctgtcacccaggctggagtgcagtggcacaatctcggctcactgcaacttccgactcctgggttcaaacaattctcctgcctcagcctaccaaggacctgcgattatatgccaccatgtaatggtggaatgtaattggggaatcctgatcactacctttaaaaagcattctctgtcctgtgcctatgctaatcgtgtggacacggaggcctccaccacttctcatcccagtggtgcctgagaaagtgtccgggttccacccacaggtgcaagaatggcttcctcctcaaagccgtgctgtactgtgcaaccaatctagaatctcataaagtctcatccctgctgagaagctcatccagtcatccatgagcaacagtttctaaatagtggcccttgcttgtctttctttaatcctaaaagtgctgagaaaataatctaccatgcaatttatcctcctgagcattcctaggatcgccttccccaacagaaactgctcctttcttcttgagttataaaagaaaggtctatatgcacatttcttaatgtaatcagatacaatttttagaccagaagagtaaaaaggaattgggattattatgtgccttaccttgcatatgtctatgttggcagataaaatatagggccatataaatatctccctaaaaaaatagtggttgatctgaaattcaaactggctattctgtatgtgtatgtgtatatatatatatatatatatatatatatatatttttttttttttgctatatttgatgaacctagccttaataagaaagggaaccacaggtcagccaaccacaaaaatccttcttaaatctgtaatcatttgaaaatgtggcttcgaataaataatttattaattaaatccataggcagcagttatcccaaaatggtcactttattaatgtgatatgaacagaaagagttattgatgaatatttcactaatgatccaaaatcatattgaaaattaaatgcagatgttagattttgatagtttaaatacgtaattgccattaatatattcacaaaatattattaggaatttaaaatcctttttattaagttatcatgatgaaattgtcataaattaagctatggatagcaaattccttctccataaatttttgaccatcactttcataacatcaagatttatttacatttttcctaccatcaatctttacttcattataaaatgcggtgctcttctaattaaaacatgaatctccatgactgattaaaatggaattataaaaatttaacattcactctgataattttgcacattaatcacggtgcaaactaatgagtacaatgggcattaaaactaatcacatgattatagtaaaataaaaatattgaggccacagattaaagttttcacaggaagaattatgcaagtgtaaagtgtttgtatctttaactcattccattaatttatatagcttcaatagaatataacatgacccataatgtttcttgttttgtgtaagtgtatgttctgttggatcttaacactatcttatttatttatttatttatttatgtttaagacagggtctcactctgttgcccaggctgcagtgcagtggcacgatctcagcttactgcaacctctgcctcccaggttcaagggaacttcctgcctcagcccccctagtagctggaattacaggcatgtaccaccatgcccagctaatttttgtatttttagtagagacagagttttgccatgttgcccaggctggcctcaaactcctgacctcaggtgatccacccatctcggcctcccaaagtgctgggattacaggcgtaagccactgtgcctggccaacagttatgttattgacacagagaattccacaatatcggttacataaatgcaatcttttcaccacttttataaaacatataatataaaaagattcagaaaattttaataaatatattttgaaaagtaatattttatatatatacaatttttttgtttgtttcagacggggtcttgctttgtcacccaggctggattgcagtggcgtgatcttggctcactgcagcctccacctcccaggctgaagtgatcttcccacctcagcctccccagtagctgggactacagggtcatgccactgtgcttggctaattttttaaaaaatatattttgtagatatgaggtctcactatattgtccaagctggacaataactcttgtgctcaaaaactttcctgctttcagcctcccaaagtgctgggctccaccgcacccaccttaaatcattttttctaaaaataaatacttttttattattttcagagatgaagtttgcctgatcttacatctgctagatgtcttgaaagtcaagtctcaccagatgagtgggagaaaaatcacataagcctaaatagtatatgtaaaaaagtgtcagcattggaattttaattctggaagtttccttaaaaaaaaaaaatcaattaggccaggcacggtggcttaagcctgtaatcccagcacgttgagagaccgacctgggcagatcacgaggtcaagagatcgagaccatcctggccaacatggtgaaaccccttgtctactaagaatacacaaattagctaggcgtggtggtgggtgcctgtagtcccagctacttgggaggctgaggcaggaaaattacttaaactccgggaagcagaggtcacaatgagccgagatcacaccactgcactccagcttgggtgacagagcaagactctgtctccaaaaaaaaaaaaaaaaaaaaaaaatcaattaaaatcccagggcttcagctttctcatctctaaaatagatacaagtatgtagacacacatatagatagatataaatatcttatatttattattaggattttgttgaagatcacagttggatcgattttaaacttggtaaaatgttaggctataaatacaaaagtaattattgtattagcacataaattatatgtagatgaataaatcataggcacttgaaagtagtatttgagtaatatatagtttttttttaatccctggaaaattttgacatcattaatttgttaagtaaacccttcttgctcagtaaattttttcatattctattcagataatggagaattataaattaatctatattattaatactatataaaattaattccttatatgtatatttatggaattattgtagccttttttcttccttcctgtaaagaagaataactctttgcaaataacctaaaaattatgatcctacagcctcacgggattactggggattgttttgttcactcttcctgggggtaaaaaattacatggataacagagactaatgttcttgaagaaaatcagtgcttccctggcatttcaggaatcaaattctcagctatatcttcttttaaagattcagaacactataaacactttttcattagatgccaaacttctgttacaacacttcactgctctagaaataaattttctggccgggcgcgttggctcaagcctgtaatcccagtattttgagaggccaaggagggctgatcctgaggtcaggagttcaagactagcctggtcaacatggtgaaaaccatctctattaaaaacacaaaaaattagtggggcatggtggcgggcgcctgtagtcccagctacttggaggctgaggcaggagaatcgcttgatcccaggagatggaggttgcattgagccgagatggcgccaatgcactccagcctggtcatcagagtgaaactccatatcaagtaggtatgtgtatatatatgtatacatacatacatctcaagtatgtatgtgtatatgtgtgtgtatatatatatgtgtgtgtgtatatatatgtgtgtgtgtatatatatatgagagagagatagactgttctgttaattttaaatagaatggaaacatcacaactcaggataatttgcttgtcaaattatacatagaactactgttctgccaggcaattgttgatcttaatctgctgttttcaccgtatggggtctctatataggatgaatctccacatttttggtctaaatgtaaaagactctatccagctctcacttatgtgtatgaattcagcctaatctgtttggaaatcatcatcatcaccatcatcaaatagtaatactcaaatttgacaaatgttctctattttctaagtcttgggcaaaaagggtcatttcattaaatctgaacagaaatctcatgacataggtactatgattattcttgcctaatagatatagaaacagatgccaaagtatctcactcaagattatatgactcataagtggcaaagctggtttttaaactctcatctaacttactacgaaccccataattcaaatattatttcaaataataatattattttaaatattttaagtaatttctattttaaataatttgattaaagaccaaatgccttgccttcttttctagaataaatgcaagctaccagttccttgcactagcctaggccagtcttgtaactgaaacccattggattcaaaatctatttcaagtacttaactttcttctgaaaattccctcagctataaatttgaggttggtgataattgcaaagatgccagggaaatttataatcattactgaactaatccttttgaaaatataaagcagcattaaatgttaatattactaatctttctaattagataaaggggcaaatgtgtccaaaaagtctgtaactaagttcattactctcatttatgcagctaagcttaagttctaacaaatgtatgttttaagttgattaaaaatatggttggctgcatttataaatacccattattaacaggctatattggtaaatatatttttgctcttatgacaagagaatgatgtactttggtcaaaaaaattatacctcaataattatctgctctccttctatttttatttgcaatagaagtgtatttattcatgcatttgtattcctattgaatgaaggatgttatgtcacttgcattgggtacataggcatcccttttgacaaataaaatcagaatctaaactacagaaccaggttaaagtgggaacagaagtacaattttaataaaggccaaagttttgctagtgtttcacttaaaatttgtttttaagctttctgaatgttctctcaaagataaagacttaatcatatatgtaccttttttgtattgttaacagggaagaaacatactaatatgaatggtattacatacattatacatgttatacaagagaagaaaattatatattcaagataaacatttttataatcacaatacttcaacataaatatgttcaatatagtaaagatggagtttgtatgatttgtcaagcaaattcttctcaattatgtttacattctatttaaaatcaacattaatgttgacaatattcatatataaggctttttaattatttaaatgggttcaaatttgctgtgttcagtattattagtaagaaaagtaggcactggtacggaaaaatatatatttttagctcccttctatgagtgtttccattaaatgctatggtctcacagttttacatgcctctcaccacctcactgctcttgttgcctataatattttattagtttaatccttctgaaataatcctggtcattcaaaaccaatacatcaaaatcttctagagtgaacaaaagaaaaaacatttgtgaagattaaaagaaaaaggagacttctcagatataataactttaaagaatacatattacaatggtggtttgatataaagataatttagatccatctactttgaaaagatgctttcttgacagttgaaattttttacactattttaagtgttttcctcaagaatttcttgttaagaggtcgtttgttagctttcaagttccttgaggcctgggtctgaaagagtatctgaacagtgggtgctcagtacaggtttgttgaattgaaccagaataatgtcagtcatatcaaaaaaagaataagagggaaaaagaaagaaagcagagcaaatgaaccgctttggttttgacacttgtacaagtgctgaatcgacagcatatggccaggtataacctagtgtgtgagtgggaaggtggattaatctgggctgaccttttctaatggacaaagcaacttggatcctctattttaaagcgcttaaaactttgatgtaggaggtgttacattatttggtcttgacttgtcataggcctctgtcaccttattagcaaatgcaaacctggggctaccttttttgcctatctggtagatatttatggcaaagacagcaataaggaattccagaaaataagttgctggcagctaagactcttttacttatctgaatggtaccaaacccacaaacttctttgtgaggtttgcaagttgcctgcttctgaaaatttttactgttcaaagctgacattaattcaaagctaccaagtattatagatggcttgccaaaatacaatatggatcgtagtttgtataaaaacaaaaatgaaacaattaaaagaaaccccacacacataaagaaagctcgcacaaatgcaagaagaccatgagatggtgtgtcttagttctggtatgacaataacaatttaatgtcaattcataattttattaagatgggagtcataatgatcatgtgccatgtgagaatatttgagacagatcaaagaagagaaaaaagaataaaacctctagtattaccaaacctttgctctattatcatttctgaaaaaaaaaattgtaaaactaagaaaaactgggacattttgaagaaaatgaagtcaaaaaggtgaatataaaattttgctctagcaacactatgaaaaactgttcgaaataaaggaataggcaaggcaaggaacctcacacctgtaatcctagcacttttggaggccgaggtgggtggatcacccgaggttgggagtttgagaccagcctgaccaacatggagaaactccatctctaccaaaaatacaaaattagcctggcgtggtgccacatgcctgtaatcccagctactcgggaggctgaggcaggagaattgcttgaacccaggaggtggaggttgcagtgagccaagatcccaccaatgcacttcagcctgggcagcaagagcaaaattccgtgtcaaaaaaaaaaaaaaaaaaaagaaagaaaggattaaagttacaaaatctcatgcctatgtcctgaatggtaatgcctaggttttcttctagggtttttatggttttaggtctaacgtttaagtctttaatccaccttgaattaatttttgtataaggtgtaaggaagggatccagtttcaactttctacatatggctagccagttttcccagcaccatttattaaatagggaatcctttccccattgcttgtttttctcaggtttgtcaaagatcagtagttatagatatacggcgttatttctgagggctctgttctgttccattgatcttcatgtctaaaacaccaaaagcaatggcaacaaaagccaaaattgacaaatgggatctaattaaactaaagagcttctgcacagcaaaagaaactaccatcagagtgaacaggcaacctacacaatgggagaaaattttcgcaacctactcatctgacaaagggctaatatccagaatctacaatgaactcaaacaaatttacaagaaaaaacaaacaaccccatcaaaaaatgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggggaaataggaacacttttacactgttggtgggactgtaaactagttcaaccattgtggaagtcagtgtggcgattcctcagggatctagaactagaaataccatttgacccagccatcccattacggggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaaggatgagttcatgtcctttatagggacatggatgaaactggaaatcatcattctcagtaaactatcacaaggacaaaaaaccaaacaccgcatgttctcactcataggtgggaattgaacaatgagaacacatggacacaggaaggggaacatcacactctggggactgttgtggggtgggggaggggggagggatagcattaggagatatacctaatgctaaatggcgagttaatgggtgcagcacaccagcatggcacatgtatacatatgtaactaacctgcatgttgttcacatgcaccctaaaacttaaagtataatagtaataaaataaaatttaaaaaaagaaaataataatatcatgatactgttcttaacagttcatctcaattttgtagacttatatgcttctgccacatgttaacttgtcttggtagtaaaaagacaaaaacagatggatgctgattgcttaatggcagaaatatttgtctgtagtttttgctactttataaaatattacaaaggaattcagaggtgggccaaaacctcaaacttaattgaaactctctagtgttgtctgacaaattaagattgtaagtcactttattatacagcatctggtcatatggtatatcatcaatgccaattatttcttttttctttaaaaactacaatcactacatatacacagttcctgcactcctagtaagaggttttgttatacatagaagtaagcaagtttaatgtactcatttcctaagaaataagagaattatcaatgttaatgttagccaaaaacgtgttcttaatgctcagtttgtacctatcattaaaatttaatataatctaacccaattatcaaaaaataaataaaacaaaatctcacaaagaggttccattgccttaacttatctagcaactatataataacatttatcttctatcaaaaacaccgagatagttttcattttagcaatttacttgtttggcactctacatacattgcttcataaaatatttaaggttatgataggcagtcctggtgtggtggctcacacctgtcatcccagctcctgagtccagaagtttgagaacagcctgtacaacatagtaataccccatctctaccaaaactacaaaaaaattagccaagcataatggtgtgcaccgatagcctaagttactctggaggctgaggtaggaggcttgcttgagcccaggagatggaggcttcagtgagtggaaatcaggccactgcactccagcctgggtaacggagtgagactctctctcataaataaatacataaataaataaagttatgataggtagaactttttcagtatttaaaaaaaaggtaagtggtcatcatccacatttttcagtaaagaaaaaagcaaggggtcaataattaaacataattaattaaaataaaattcaagatttaaaggaatatcctatttgacaaacttttgctttctttttctgtgaaaatctcacctgaagatgtctgagtatcaggggaggagtaaggaggaataggcaggaaaacctggctaggagcaggatgtttagctttcatttgacacacagctgtcaaactgcactgtgtgtccttttccattgtaaacagtcacataatacataacaaaaaaattttaaaaagcaatgcatgtatacttctagtttatatgttgatttatttgaagagtcgtaaattattaaatactaagatatactgtattagatgtgtaatacacatacgttatatatacatgacatatatgtatacatgctacacttgttttcatagacattgagttctatacatgtaaattaaagtgataaggattttcaagatctcactgaaagaatacctcttagagtgaaaatcataaatgaatatacataacgtatttctagtagaaaaatgaattcccttgtctagatgcagtcagtcgtgagaaaaaaataaaaggaggaagatatctttagagatttcttattgcgccggtatttttcatttgccctggcaagtccaatctctattcttctcaaacttgctctgtgcacccaggaggctgaaatatacaatgtattatttccagggctcccttactgcctgatgtcagtggggttcagccaataaaaagcaggagcaagtgactggaggaagagagaagaacaagaactggaggaagagagaagggtttggtaagtagttacactcctggctccctcctgcttctaggaatgctggcattaactatttccttgaccaaaactcaaagatccagccaggcagctctgtcctcacaagcttctctgtctatggattttagtaaattatttacctctcccctataggactaggaatgataccagggtccctttattactaactgagaggttctagactattcttgtgtggcttccctgtggggtgcccaaatctttattccatgtttctcaagttaccacatcagttatcttttggaaacctgaatgcacacctaaaatatctagaaatttgagacctttgttttctggatctttttcaagaattagtttaggtgctgacttgataggaatttagcagagtattttttcaaaaatacacttaaaactacgtcaaactgttatttaattatgtaatatatttgttgctttatctaattagatttgcatttcttatatataccatgcatataaaaatatatttgatacaaattataatacaaggcatacaaaactagaccattataataacagaacattttctaaagagattttaaaagtgtaagtcaaatgccttaacgtaatactacttctaaagtgtattctaaagaaataatcttctatgtgtggttagatttaactacagaaatattcattgtaacctttctttagaagtgaatattgaaaactgaaataaatctaaatgtccaactttataattgctagttatggaatactaacaaatgaaatccatgcttttaaaatagcatttagtgacccaaatatatgttcaaaatacgtataaaagaaaaactggtatgttattaaagaagatagaataaaatttcttttccaaaatgtatgctaacaagacagttttgaaacttccgaaaacgaaaatgttgttaggtaatattttcactaaaattaaattttctgtttgctgagattataggtgtttctaacaaattttactgttgtttatgtatgctatagacactgaacatgtataatttatgtatcaaggaaaaaatcagtaagttcaattttttcaataaaaattaaaagtcacataatatatccgagaagataaagacgaattacactttatctgacaaaagagagtgcatggtttatggagagagacaattttttctctggttttagctctaagatataaaaggaatttattgtatacatctggaaataagaggtactgaatacctaaaatatattaagattaattactgttttagctttttttttaacagtatagaagtattgtgtgatgacttatcttatcaaccattgaaagagccattttcaaagactgattaaaatagaagacttccataaacaattttcaccgaagcattgaaaactattatctaagattaagaaaatacttttctagggatccctcatatctagggatctaattaccattagatccacctcatataatggaattaggacaacccaaagatctggatgattgaattgtcatttggggattattaccatcatacagctcagtttatggcaatttctatacatgtatttagtattaattgaaggaaactcataggaattagatgtcagacatgaggactacatacatatctttagagtgcttgtgtcctaaactgaaaagtgtattttaagagtctgggatatgaaaccaactttttctctattcttgtcaaatccatgtcattctagctactgacataatttgcacaatataagtacaaataataatgagcaaatttatgtgaaaatatgtttccagtgtacaggtagttttaaccattctttttacaagaaatgtgtgtgtgtgtgtaaatgtcttaattgttataatgattaagtcattcacagatgtgttaacaatgttttctccatgtagacagagtgataataatttgtattacattttagagttgtttgatgcaaataaataagaactcaaaatttttttgaggttaaacttcaagaagatgaaaggaaaactaaaatcacaaagtaaaatataattaaaacatttcaactaagaaaaaagtaaaaagttaggctgtctagacaatgtttgaagtttaagttggttaattgcaatggaaaaactgctaattaccacaaatagtaatttagagacataaatattatacaggtgtggctgcaggaagttgattttaatcaaacacatttggcgtttccaatgttgcaaaaattacaattgtaaacactgtccaattcaatcaaatgttatgtgaattttaagtgagtctcagtaaattatactgtataaaaacaggatttttactatggatcataattgctaatgtgtttcatactcgatgttgaaatataaatcaattcactctcttatttggtttggaaatttaagaagacaattcaaatttcccctgatacactctaccagtgtcactggactggtgatgtgacaagaaaggtcttctgtagaactgaactgcaataatatggagactgtaacaaaattacatatgtacctaagaatattgactttaaaagccttcttcagattgcagcattgatttctagatctgttgggaactggctgccttacttaatgtaacagtcttggcaatagaataatcatatttatcacccatggataattaatttttaatcattgaaattcactgaaatatgttgaatatgaaaactatacaaatataattttgtatgctacgataagtttcagattctttgaaattttattctaaccatcaatcataatggtatagtatgataaaggtagaacatgtaattataaattcaacatttaggaagtttatttttctcttctttttaattatctcaaaatgatcttgatttctgcaaagtattagtatatctggtaggtgagagtctatttcttttaaacttcatctgtattaaccagctttataccaccaaaatgtcccccaaatttaaaactttacacagtaaggccttatatgcacacctggcctcatttcaaaagactaaagcagtggttctcaaattcagctgcacattaatagaaactggaaaactgtttaagctcctgatacaaagccacatgtcagactaatttatgctgaatcactgggccaaggacccagacatcagtatttttaaaaactatggaggaataaccaggattaagaaccactgcacaaaatggtaaatgcaacttttatttaagttatttttttaaagaaataatggttgaattgatactgatcttagtaccaagtcacggcaattttttctgacttagagaattcatcctggcgttaagattattaaagaacctagaaattcaagtgtttttgtttacatttttcctgtaaatattagagtatgctagtgctcagccttatttgataattttggaaaatatattaaacatttgagattaaatatcaaaaatctctaaaataattttagaaataccattcttctatgaaataagtaagctcagtcaagatacatattatagtgcccatttaagaacgtctaataataatgtttgcactgcttaaagattaggttgataaattaattattgttgattctacttgcataatcaacagacacctagagatggagtcttaagtatagacacagaagttgaatacttttaagaacttttaaatttacgtcctggttaaatcttactctaaaattatgttgcatggttgtgattagtacatgtgtgattagaaccgtctttctcaggttattacaccaccatatagacacagcaaaaataataaaattaaaaataaagcaagaaaaataatgtaacactttattggctttgagataattattttgagatcctaatcctaccaaaacattctgcttttcttaatttgatcctacttttttttctttgctcgttttaataaaggatgaaccaatatcctgagaaattttcaaacagggctgagtataacactcagtccctagatctcactgtattttagaaaaattgtaaagtatttcaaataatgagtaaagtttcaactctgcaccattgtgtctttgtaatacagggaaagtcacttcacttctctccctctctcgtttttggcatatgcaaggcagagaaaataatatctactccagctatcccataggttattataaaatataataaaagatagaaaatcactttataatattcaaagtattaaaaaagtaaggcatgattatatgtgggattaacagcagtttgttatttaccatttaatgtattttaatgtacgtttttgccatatttaaaaattataatttttacattttgatttttaattgaaagagtaatagtatgacattatgccatgttatatctgatgccattatgtcaaacaaacaaacaaaagcattttaaactatttggaatatgataaaaataaatcttttaactatgataatacaggtttttgaggatttagtttgtacagcaaaaacagaggcaataaaggcaaaaatagataaacaggattacttaaaactataaagcttgtgcagagcaaaggaaacaggagggtggagggtggagagacaacctacaaactgggagaaaatatttgcaaaccttatatctcaatgtactagtgactatcaccctaataactagtcacgggagcattgtcatgcatttcgtattttttaattttcgagatgctgccacttaccatggcgggagcctgatccctgcggaatcgattgtggctggacttatcttgaatattctgagtcaacatacccaaccataaggtgctaattcattcatgcttgaagggcataacaatcaatacacgttcacgcacacaagtacgttcacgcacatacgtacgttcacgcacacgtacgttcacgcagatacgttcacgcataatttaaaggactacttctgattaaatccgaaaatccaccctccctccatctctgactttattgttaaattaggtaagaggtacccttgccgacccccagaaacaagatacttaaattgaacctagtcagaaccctaaaaatcataatttaaccatgaacactccaacactagcccctcgattaacgtaattttctaaaaaatcccaatattctccaaccaaataaaatctcctatttatatgttaactaaatttctgtcttaatacttatataatacttcaagcatccctctctgaaaagtgtgtatcccagatattatagtcctaaatcaaatataacttcaactacaaatgtcaccttagccaaaacctctgctaattcaacttttttaaaggccctaaacttccaggactgcaaatgaccacttcagatttatacccaacaagattctaccctgacatccccctagtatttcaaaataccactcaaatgtttttcatccagttaatgtagcttaattatttaaagcaaggcactgaaaatgcctagatgggtccgcaaaaccccataaacatagaagtttggtcctggcctttttatgaattctcagtaaaattacacatacaagcatccccgccccagtgagaatgccctccagatcacctggttcaaaagaaggaggtatcaagcacgcataaacgcagctcaaaacactttgctcgaccacacccctacgggaaacagcagtgataaattttaattcataagtgaaagtatgactaacctatacaatatttagggttggtaaattttgtgccagccaccgcggccatacgattaacccaagctaataaaactcggcataaagagtgtttaaggtcttcagtcaacaaagttaagctctatctaaatcgtaaaaatctccagctgaaataaaatatactacgaaagggactttaatgtcctgaggacacaacagctaaggcacaaactgggattagaaaccccactatgcttacacaaatagttatattaacaagactgttcgccagagtactacatgcagcagcttaaaactcaaaggacttggcggtgctttatagccttctagaggagccggttctataattgataaaccccgatatacctcaccatctcttgtcactcagcctatataacaccagcttcagcaaaccctaatatatatatatatatatatatatatatatatatatatatatatatatatatatagtaaacacaagtatgcactaggtcaaggtgtagtccatgggatggtaagaaatgggctacattttctacatccagaaatatctcacaataaccttcatgaaatctaaatgttcgaagaggatttagtagtaaatcaagaacagagtgcttgattgaataaggccataaggcaagcacacaagcccgtcaccctcttcaagtagtgctctagaaatcactattattaataattgcttacacacatacagaggagataaatcgtaacacggtaagtgtactggaaagtgcacctggataaaccaaagtgtagcttaacccaaagcactcggcttacacccggaagatttcattacaacctgatcgctttgagccagctccagctccaagccttgctaaaaaatattattagaactacttaaatcaaaccatttaccctcgacaaaagtataggagatagaaattacttattctggtgcaatagatatagtaccgtaagggaacaatgaaagaactatatcaagcaccaaaaagcaaagacaaatccttgcatcttttgaataatgaattaactagaataaacttcacaaagagagctctagccaagtcccccaaaatcagaggagcttctccagaacagctagaagagtacactcatttatgtggcaaaatagtgagaagattcattagtagcagtgacaagcctacggaggctggtgatagctgattgtccaaggtagaattttagttcaactttaaacttaacctacagaattacttaatcctcctgtaagtttaactgttaaagggggacggatcttcagatactagaaaataaccgtcctatagagagtaaaagattttaccaccataattggcctaaaagcagccaccaattaagaaagcgtttaagctcaacatctgactaacttcatttctaatcaccctgttaaactcctaatattacattggactaatctattattcagtagaagcaataatgttagtgtaagtaacattaagacattatccattgcataagcttacatcagaccagaataatccactgacagttaacaacctaatattaacaaatgattaatagacatcttattatctttattttaacccaatacagtcatgctctaaggaaagattacaaaaagtaaaaggaactcggcacatttcaccccatctctctaccaaaaacatcacccctagcattgctagtattagaggcactgcctgctcagtgacatatgtttaagggttgcggtatcctgaacttgcaaaggtagcataatcacttgttccctaagtagggacttgtatgaatggccacaccagggtttagctgtctcttactttcaaccagtgaaattgacctacctatgaagaggcgggtataaataaataggagaagaccctgtggagcttgaattcattaatgcaaatagattcaaacaagccaacaggccccaatgtatcatccctgcattaaaaattttggttggggtggccgggcacagtggctcacgcctgtaatcccagcactttgggaggccgaggtgggtggatcacgaggtcaggagatcgagaccatcctggctaacatagtaaaaccctgtatctactaaaaatacaaaaaattagccgggtgtggtggcacatgcctgtagtcccagctacccaggaggatgaggcaggagaatggcatgaacctgggaagcagagcttgcagtgagcggagatggtgccactgcactccagcctgagagacagagtgagactctgtcttaaaaaaaaaaaaaattggttggggtgaccttggagcataattcaacctccgaaacgacttaaactaagaccgcactagtgtaagtcagttattacacattgacccaataattctatcaacaggataagtgaccctagggttaagagtgcaatcctattctagcatccatatcaacaacagggtttacgaccttgatgttggatcgggacatcctaaatggtgtagccgctattaagggatcatttgttcaatgattaaagtccttcgtgatctgagttcagaccagagcaatccaggttggtttctatctatttagcatttttcccagtatgaaaggatatgagaaaccgggcccacttcacaaagtgcccttacaagactaggatttttacacaatatgctattggttactgagtgctattgtagaaccggtgcccaggtcttataaatttcaggttcttatgctttccactaagctgcattgcccttctccttttttaaaattttttaaattaatttatttatttatttatttatttttggctccatcctacagactgtctgggagttgtggtacagatattttcagccatatttatggtagtttcccacctcacttgaggtctgtgggtagcaaaagagaaaagttagctttttttgccttttccatgccctcctgtttcttcactaaaccacattcaataaatgatctaggagcttttacaatgctccatgtacaagaacctcacagaggaattacacacagttcctccttccagagagctctccatatattacgagatcaatttggcaaagagaattacaataaaatgcagaagtgctgtgagagagttgtgaatggaatgatgtggaaacacatacacttatatattgaattctatcctaagaagttaggaaaagttttcagtaagagttggcatttgaactgaatcttacaggaagaaagtatggtaagataattagaggaggatgtgataaaaacgaggtaatcaaagtcacattgaaatgtgtgaatttggtggaaagtcactagttgttgaaggagagaggtagacaggaataacgtaaaagacaggagccaggagaagtagatttaaactagatcatgcagaattatatacaagactaggatttttacacaatatgttataagcaagtacaagtaagtgatgttaattaggtggattgaaataatggttgcaagatagaggtgatagagaaattacagatatattatgacaatgatataaagaataaaattgagtaaaaaaatagaaagctgttaaacataccagagaaattattaaggttgaattaaggtagcaggaacaaaaaagaatttcatgtaagaaaaatcttcagatagtattgaaaaattcatatactgactagatacaagaataagagaggtagaagaaaataactctgagtttccttgaatgaaaggcagatgacaaactgaataattaagttataaaatacacacacacggggggaggagccaagatggccaaataggaacagctccagtctacagctcccagcgtgagcgacgcagaagacgggtgatttctgcatttccatctgaggtaccaggttcatctcactagggagtgccagacacggcgcaggtcagtgggtgcacgcgccgtgcaccagccaaagcagggcgaggcgttgcctcactcgggaggcgcaaggggtcagggagttccctttcctagtcaaggaaaggggtgacagacagcacctggaaaatcaggtcactcccacccgaatactgcgcttttccaaccggcgtaaaaaacagcacaccacgagattataccccgcacctggctcggagggtcctacgcccacggagtatcgctgattgctagcacagcagtctgacatcaaactgcaaggcggcagcgaggctgggggaggggcgcccacaattgcccaggcttgcttaggtaaaaaaagcggctgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacaggcagactgcctcctcaagtgggtccctgaccgctgacccccgagcagcctaactgggaggcaccccccagcaggggcacactgacacctcacacagcagggtactccaacagacctgcagctgagggtcctgtctgttagaaggaaaactaacaaacagaaaggacacccacaccaaaaacccatctgtacatcaccatcatcaaagaccaaaagtggataaaaccacaaagatggggaaaaaacagaacagaaatactggaaactctaaaaagcagagtgcctctccacctccaaaggaacacagttcctcaccagcaacggaacaaagctggatggagaatgactttgatgagctgagagaagaaggcttcagacgatcaaattactctgagctacgggaggaaattcaaacgaaaggcaaagaagttgagaactttgaaaaaaatttagaagaatgtataactagaataaccaatacagagaagtgcttaaaggagctgatggagctgaaaaccaaggctcgagaactacgtgaagaatgcagaagcctcaggagccgaagcaatcaactggaagaaagggtatcagcaatggaagatgaaatgaatgaaatgaagcgagaagggaagtttagagaaaaaagaataaaaagaaacagaaacgagcaaagcctccaagaaatatgggactatgtgagatgaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctggagaagagcaactccaagacacataattgtcagattcaccaaagttgaaatgaaggaaaaaatgttaagggcagccagagagaaaggtcaggttaccctcaaagggaagcccatcagactaacagtgaatctctcggcagaaaccctacaagccagaagagagtgggggccaatattcaacattcttaaagaaaagaattttcaacccagaatttcatatccagccaaactaagcttcataattgaaggagaaataaaatactttacagacaagcaaatgctgagagattttgtcaccaccaggcctgccctaaaagagctcctgaaggaagcgctaaacatggaaaggaacaactggtaccagccgctgcaaaatcatgccaaaatgtaaagaccatcgagactaggaagaaactgcatcaactaacgagcaaaatcaccagctaacatcataatgacaggatcaaattcacacataacagtattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaaccaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacagctacagaactctccaccccatatcaacggaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaaactgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggtttttcgaaaggatcaacaaaatagatagaccactagcaagactaataaagaaaacaagagagaagaatcaaatagacgcaataaaaaatgataaaggggatatcaccaccgatcccacagaaatacaaactaccatcagagaatactacaaacacctctacgcaaataaactagaaaatctacaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagtcgaattctaccagaggtgcaaggaggaactggtaccattccttctgaaactattccaatcaatagaaaaagagggaatcctccctaactcattttatgaggccagcatcattctgataccaaagccgggcagagacacaaccaaaaaagacaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcattatacgcaaatcaataaatgtaatccagcatataaacagaaccaaagacaaaaaccacatgattatctcaatagatgcagaaaaggcctttgacaaaattcaacaacgcttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagagaagtcaaattgtccctgtttgcagatgacatgattgtatatttagaaaaccccattgtctcagcccaaaatctccttaagctgataagcaacttcagcaaagtctcaggatacaaaatcaatgtacaaaaatcacaagcattcttataccccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcattgccaagtcaaccataagccaaaagaacaaagctggaggcatcacactacctgacttcaaactatactacaaggctacagtaaccaaaacagcatggtactggtaccaaaacagagatttagatcaatggaacagaacagagccctcagaaataatgctgcatatctacaagtatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacgaagggctaatatccagaatctacaatgaactcaaacaaatttacaagaaaaaaacaaacaaccctatcaaaaagtgggcaaaggatatgaacatacatttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaataggtgctggagaggatgtggagaaataggaacagttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaattgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacaagttagtgggtgcagcgcaccagcatggcacatgtatacatatgtaactaacctgcacattgtgcacatgtaccctaaaacttaaagtataataataaaaaaaaatacacacacacacagagacagagagagagagaaagagagagagaatatttaatgttattttatactttataatttgagtcatttataaaaatatccaagcaaaagcgcctactggtcaaatgacagaacctgagtctagatctgaaagaaacctttggtttgtagataaagacgggagcgtctatgagtgtagaagtaataatggattacacatagagtacaaactggactgataagagaataaaaacaattacaaacttcacagaagagacacagcgagtgactataatttgtaaaacaatatagacactccaaaatttggaggaaggaaggaagaaagggaggatggaagagacagggaagagatagggaagggaaggggaagggaagcagagggaaggggagggggaagaggggagaggagagataataaaatacagcagggagaagaggcaaaaaaattagaaatgatctgtgttccaggactcaagaaagagtctcatctcctttaacacattttctgtacttcattgggtaggacagaaaatgtgttaaagcagatgagactcttccttggcgaggtaaaaattagatctcttttcatatgaatttacttcaagctatagatatccataagtaattggtatatatctgttaccaaaacaccatgggttctgtctagatcctgccgctcaccacacaggaagccaatcactgagacaatgactattgccaaggaagaagactttaatcaggtgctgcagccgaggaaatgggagatcagtctcaaatatacctccctgatcgactaaaactgaggggtttacatagcagaaaagaagtgtaactatgtatgagaataaaaggaactcagtgtgggataagaaagcaatcatgatgaagaaagggcctggcatttcattatctggatgtgatgatctggtttcagttctttgatatgttctgagaggcctggggatcctttcctgaggaaggaactcagataaaacaaatgtaagtttcaagctttaaggccagaagggttaatttctgttaatccaaaagcgattgtctatgggactatacatatatgttatatatatatacacacacacacacacacacacacacacacgcacacacatatacacacaatatttgagtacttttctttttttttctggacttgtgtcccttgctaaatgtttcactattggctattccagaaggtaaaaatgacatctgacctgattgggaagaattgtaattcttatatgtgcaaaaacagatgagagaggatttgcactttcagataagtgtaaccaatctaaatgtattgcattatatacaaaccacactacaccagatgacaagagatgagaaattcagaggcagctccagcattacaagttgtgtgaagatgggcatgcactatgccttcaaaccttggtctttatgttcataaatagctataaatataccttccttaacatctcatagctctcatggtaatcatgtgatgtcaaatatgagaaaatttttaataatctgtaaagtattgttaggtactcttaggtattatgaaaaattgtgcccactgttcagatctttatatctccctgtgtacctaactattggaatcatatgtcaaaatgaaaggcctcttcatttatgtataaagatattgtatcatccaaatattcaagttcatgtacactgtccataacatagtatatgcaagaataatatatatcaaaaatctgaaaaaaatcataatcgtgctatctatttaacattaggcttatgctcaggcatatgcataaaatgataagtaattcataaaatgagtcaacacttcatctggtacataagcttgcaattgcacacagagatttcatgtgtggaattgctctgaaaagcactgttctgtaaagataatatttagaaaataaatatctgatcatatattgttaactgtaatacaaaagcaagtagaaatagctccgtaaacaatactgtcataataaggagcaaactgtcataataaggagaaaaaattgaaactatttttaaaataataggcaaaatagaatgtgttcttcaaaccttgtggattttatactgaaaacttccagagatatatcttaggtaattataagaccaagcacaacaacaacaacaaaatcctaacttgaatccatcagttgcagatttcatggctgagtacatcaagaagaagttgcaaactctaaaagctggaaggccagtcaatatcaggaactcctcagaagtgaatgaaaagcagtttaaatttgtttaacaaaaccatgttttcaaactaactttaatttatgcatgagggccattaaatttgttctttttaaaaaggaaacttcttaattggaactaatcattcattattcactgtgatacaggttatatactcttaggttccatgtgattattcacatgttcagctgacagaaaggagacaaagctattctaatgacttagctttgctttgactcattggtttttatctcactttaacttccaatctcggttacaaagagtgttaaaactggaagaaataacattttggtagatggtaaaggataagtacgagtcatttcaagttgttgaagctttcattaaataaagcaagctatttgaaatcttaaagctatttaaataaagggctaagacgtttctgttttatatacttaagagcttaaaagatactgttgaaaatttaactgttaatctattgtagggtgtggttagacatttattttgacagtgctcactgaaaattcaattatacccccagagtcaaacttgcccgtcatcaaaatgtctaaagatctgagtgtttatggggtaacaacaaaccccatactaaacagtttgccagaaatctgtcctacaacatctaaatggaacaattgggtggttgtctaaggcacctaaactcaatatgatgttttagctaaaaagagtgaaattatacctaagcacttcatgcaagttaccaaaagagaagatattctttaataaaaaagtacatttgtagaataaaagaatctcagtgttgtaagaaatatttgagatcatttcagttaggcttttcatttcttaaattagaaactgaagctgagattaaacagctaataaaaagacaaagttgatccatgacattggtttgggcgatgatttcttagatatgaccaaaaatgcacatacaacaaatgagattacatcaaactaaagagcttctatacagcaaagaaaacaattaacagagtgaagagtgacaactcacagaatgagagaaaatatttgcaaatcataggtctgataaagagttaatatacaaaatatacaaggaattcaactcaataacaataaaacaaataaccctgttaaaaaaatgggcaaaagacctggacagatatttctccaaagaagacatacaaatggccagtagagatattaaaaggtgttcaatatcaccattgattaggaaatgcaaattaaaatgagatttcaccttactcattttagaatggctattacaaagaaaaatgaaagacaagtgttggtgaggatttgaagaaaagagaacacttgtaaaatgttgatgggaatgtaaattagtgcagccattatggaaaacagaagggaggtttctcaaaaataaaaaaaatataattactatatgacccagaaattctacttctgggtgtatactcaaatgagttaaaatcagtatgttgactagatatcaacacttccatgttcattgcagcattattcacaatagccaagatatggaaacaatctaagtgcatatcaagggatgaatggataaaggaaattatatatacatatttatagtgtatatacacaatggaatactattcagcttttaaaaaggagaaaattctgtcatttgtgaaaacaaagaaaaatctagaggatcgtatgtaaagtgaaataagtcaggtacagaaagacaaatacatcatgatctcacttacacgtgaaaagtaaaaaatgtcagactcatagaagtaaagagtagaatgatggttaccagaggctggaggaggcgggatagacagaaaaagaagatgtatttgtcaaatggtacaaggttcagctagataggagaaataagtcctagtgatctattgagcaatagggtaattatagttaataataatgtattatatacttcaaaattgctaaaagagtatattttaagtgttctcaccataaagtaatgataaatatgtgagttgaaagatatgttaattcacctgatgtaaatgttccacaatgtatacatgtatcttaacatcaatattgtatgttataaatacatataattaattatcaaataaaaaattaagatggagctgagccaagaatccaagactctgaatttagatttttcattttctattatgccaaagtgtttcctgaaaattaaaattgaatatggcacgtccaaaagaatacgtcataagaagacaggaaaggggggactgctgcatatactcatatttttagtcagttgtgtaagatcttattagaggaagaaaatcagatattttaagaaaattcttacaactcccattatactgaaattttatggcaaacctaaaaccttcaaaatatagggttttatttaaagtgaatcatatatttgcaaagtttttattgagattatgaaagcaaaatctctcaaagtagcaaaacataagtatatattttagactgtactgtgcagaatagcagaatggtaccaatggcaaagaaattttcaaaagaaataaaaattattgaggtctcatcccagctctactaatctatgtcttagcaacctagtgtaattcctacaaattctgagcattgcctttaatgtatctgcatggttcccacatcatttcataaacttcaaatactcacactttataattgaaacaatatacaaactatattattaaataagctatggtatgatattctcaatctaccctataaggatactatcttcctgtcagaaaagttgagactctccaatacatatttactagccagattttttttttttttttttttttttgagacggaatctctctctgtcgcccaggctggagtgcagtggcacaatctcggctcactgcaagctctccccagatcttaattgtggaatctccagacagtgtccagtcagaaatccattattagttttgcctcatgttccctaaccaccttctctttaccttcaatcttaagccccaaaatgaaagttattattcttggctcaattatccaaattctttgaagggaactggtgacactatagcctatctttacctgccgccttgtgatccaggcttcctaggtatctgtgaatattcacattaggttacctggactccatagaggcagcaccaacaaaaaacataattgggatatacaccacttttagactttcaaatacatgccccaccttataatatgtgaactgattattcacttctagacattcaactttcaaacagttatgctctgtattaaacatcaacatcctccttccctttcattgaaaggacaccgggaaaacaaaaagatgcaagggaaagttcacacataaggataatcatttgtgataatggtgacaatgatccctatttctttttctgctcttatgaatttgcaaatgtcctacaaactaagtgtattaaatgaatctgtgaaagttcatctaagtccctagtattatttttttcttactctctagaaagtcatagcctcgtagctcaaagccaaatagaaaagatgcaaatcattcgtaggacaagggttgatgcagctttcaattactgaatacatttttagccatttaaaactaaaagaaaagtaatgtcggtaatcccagcactttgggatgccgaggcgggtggaacacaaggtcaggagatcgagaccatactggctaacatggtgaaaacccgtctctactaaaaaatacaaaaacaaaaattagccgggcatggtggtgggtgcctgtagtcccagctactcgggaggctgaggtgggagaatggcttgaaccggggagacggagcttgcagtgagctgagatcgtgccactgcaatccagcccgggcaacagagccagactccatctcaaaaaaaaaaaaagaaaagtaacaaaactcttttcctctttttttatgatttaaattttactttaggtttgaaaagtgagatatatatcacttaacagtcaggaagcgtgtagtaaactcaatctctgaaccgacattacctaaaacagagatgttcgttttcttatactcatctctaaaatagaggtagacagagaaagtgctgcttttttagagattgtaatgaattcaaacatatccattaatattatagcagttattttggtttcacagtgaaacataaaaagttctatcttattggaaagaaaaccaagtagctacctaagtacttgatgagaaggaatttgttctactgttttaagtgcatgagggataaagcaagacttagaaatatttttgttagaccgtttcattttaatagtattttctgttataacagaaatgacctacagtaaaataattcaaaatacccttccttctgaaggtgatttccacataaaattgtaacattactatgatctaaatttaaataaaattttctattgatgttaaaagtttgataatacacagtttgttaaagtggtttggtcactatttgggtatgatcaacttcaaaccataggtgtttaaatgaaccaaagtctttggtttatttctatagctttttgtctaattttattaataactagtataccagtcattcatatacagtcataactggccaaccaaggtttacttcgtaggagggtgacagtttaccctttaataccacctaattaaaatacacaaaatgttctacacaaataacagcaaattgtttatttctaagaacataattttccttttataggaagctctcaacattaatttggagccacattttaattttataatgtaatcattcagtaaatggtcattagatattgggttatttggaaaattgtaaaaaatcagacttctgaccatgtcctttaaaataattaacttagctggaaacagtaaagcaagacttaaaaatacaaatcataacatgaaaattcaaatgattgtatactaaaacaattgtatgcaaataattaagaacagtgactataataaaaaagtttaatagatttgacaaaacatttaaagaatataacttacatatatgaaaataagacatcaaaacttgaattgaagctgtcaaactgtgaaaaacagtagtaaacaataaaaatcacttactcattggaaacactgcaaaatgtcattaaatcatttcagaaatgaaggtacattaatgaaaaataatcatagtttttaactcagtctcacctcacctttaagaaacacacagtataaaacagcaataaatgggataatttatattactgcaacaaaatgcaaatatatatattgtatacgagcaccctctcttcaatgtatactttaacccaatagctttctaccactagaaatttatcagaagaaaataatggtggcttaataccagcactataataccagccctctgataggctgaggcaataaggtcaattgagtctaggagttccagatcagcctgggcaacatagtgggattctgcttctaccaaaaaataaaaataaaaaataaaaaatgccagtcatagtggctggcacctgaatctttgctgcttgggagactcatatgaacctaagctgatttgagcaggaatataatttcagtccaggaggttgagtctgtagtgagctatgatcattccatcgctgcagcctgggcgacagagcaagaccctgtcacatacacaaaagaaaataattcagaatgtgcacaaaaatgtataaagatgtttctgaaagttgcatttgtaatactgcaaaatcaatgccacattgagacagaggtaccaagattaagctggagtcaccactgacaattgaaatctggagtcagaatgctgtatctaagtgggacaacagtttctttcctgcagcccaccattaccatgcagcaaagttgctctattacttctgaattttccacatttttaaagaaaagcagaaaatccagtttctaagacaaaaatcaagttacaagtattgacagaaaaatcacttttaaataattgtaaacagtaacaacacactttaacagtaaatctaattcagcctgataccaggctgtaccaatagatacaatgaaactgcataatattggtaaaacaattgtatggtagaaaaatactggcataaaaatgttcatagcaaattcataaatggaaaaagtagtctgttttatttaaataaaaaggagctagatgaattgcagacaaccatgtattaatagttacatctttcaattttagaattaatatactttattttttgagttttcattattgtgatgtattatgctgaaattagcaaaaaaaaaaaaaagagtaactctctgagtgatacagaaatttgtaatgagaaataaggtgtgtccctaaccaacccacctatgtgtcagtttgaaggtagcaagaaaatttttatcacagtcagggagaatgggaacctgtgatatgtggcagtgacatattgataacactgtgcactgaggtgacttgagaagtatttgtgtacctaacgatttccagtgtcataaaacataggtaagaacactgaatattagcactggttgatatttggtctctacaatagtgagtatggtggttacttctagatgtcaacttgaatagactaagtgttgcctagataactagtaaaacctattaaagtgttatttaatatagtattgtagaatatacattaagtacattattatgttacatgtattataatgtaacacattataatatattaaagacattattacattaatacattacttagtatagtattacttaatacattaaaatggtagctaagcttgaagaatccctgagcagacaaacccagttagacctcataagcaacctctcaaccttgcttgctttgcaaacataaacaaaacttcaggtattttttgtaaatgcctatatgaaagaaaaacagaactttctttttctttccaaataggagtgtttactatagttttcctattcctgtatcacattacacactgagtgtgtgggagagcagagagatttaatttacaagttttagatcaagagagcataaccagatcccaggttaagacttaacactacagaatgctcacattagtaatactcgtcttataaaaagatatactcttcactgtaattgctgcaaacaataaaatactgtaaaataatatgcagtgtgtttgtgaaaggtcaataacatgcttatatttttgctgttgaaaaactacacaaaagcaaatgactagaacagtagaccaattagtatcagtagaattataccatcaaacattccactgagcttgaatgtaagatctgacataaccagataattccatggcagggcaataaactgcatttacattctctttctaacaattagtgcaagcatatccagataaactatattgattctacattatcttagagtgaaatcacctaataacttcttcagtactctttcttttaatttttatcctaattatctgtctgaaaatgatcttttaaattgggaaaactgattacattacatccttcagttcagagtagcattgggtaacgacattttggctgcagacaaatcactctttcacagtcatcagcttttagaacattcttagactttgttttccatctaaacttttcagttaattttactctaacttttaattgatgttactgagtagcaaacgagactgaaggacactgctttgttttaaaaaaatgaagaaagaaaggcatgtgaatcctataaatgtaattctaatgaaatcaagataaaatatagtgtttatagaaagaaatacaattatttctaataactgctttcatttcaaacaattttcaacaagttagtgacatagaataaatacaattctagaagaatccaggattttttttctattgcattgctgtttattaaattatagctacttgaaggctttgaaaaattgaacaccagtaaaactgtccttcttttgttaatatgttttgttttcttgtttcatttttaattcaactagtcattcaccagaaaaatttactgaggtaaacttttttgattatcctttcatagcatttaacacaagtgttatttgttgtagtcttttgtatatgaatctattaatgctgagaaactgaacattcctaggagtgtcctaataggaaataaaaattaacaatttcaactgtactgttacttaaataaatattcatatagtttacctttcagtatcatgacaaacactttgattatataagaaggtctttgtatacacatcaaactaccaagaagtcgtatctgattttgtgcttttctactactcttccccaaaacacttgttcaaaatgtttacttttaaagggtctgaactgtgtgtcaagcactgacatcagcatgttacctgaattatctcattaaagtcttgtgatactcatgtggtattagcggtgaagaaactgaagcacagaagcttcaagtaaaatgtccagttttagagaaactaaacagtagagtctggaagcccaattactgaccttgtacaattgcccagtattgtgtactgacctaaaaaggcctatgagatatcaacccattaagatccatgacataaagaaaattgtttgtcctacaatatcccaatctggatgaaggcagataaagagaatgtgcttaggcatgatgacaaaaaaataagaaagaactgtgaatgcactttacaaaacagaaaggaacacaagggagtttggaaccaagttgaaaattaaacatgttcatgtgcacataacaaaagcgtgatcgtaaataaactgtgtcaacactgtactgtgaaggtgaaactttctttttaggatcagctaaaccctgtataacttgtaaaaaaatgcaaccacgtatgttgatgtactaaacccaatatttcttttggcttatatactaaaagcagcaattctttcctgtaatgaagaaaaaaacacaggcatcaaggagtaataaaaataatgtcttagagtataaaatacagaaacaccaattaaggcttttttttaacataatacatgtaaaaactgcatcagaattttaaaaaaactatagcgtcattggttctggcaataagcaaccacactctgctggaggtaactttagtaacgtcaaacaaaagtcttaaaattatgacaggtggtattcatttaaaatatgctcaagagctattagaaatcaagaacacagtatctggacccttgatttgaatccacactcaatctctttctaactgggaaattttggacaaagttttaaactttcctgaacataaaatgcctagcttgcaataactttagaaaatactaggagtttgtaaagttacgagaatcaaattagttaataaatgtaatgtacttaaagtaataactggcacaaaataattataattcattattatttttcaatatctaaattctctagcttgtagctattttgagcatatttgaaaatttctaatatgtgtttttgattacttatcatgtagaaaaatatagctttccagatgaaaatgtagtatccaatgtagaagtcacatataatatttattaaactggaatgctatcattttaaattattttgaagctcattaaagtaagtctgcactggccaactttttatttattaattaaatttttgcctagcacagttaatctccttttctaagacttaattcccaaacctatagtctttcttttcccatttggagatgggtaggagtactattcctttcttgcccaacccttcctctattttcattataataaccagtatgcccttgcctaagcatatgcccccagttaataatacagattcactgtactgtttcaccaaatttaacccgttatttttggaaataggatgtttaaaaatgggtttgttattccttaatacatgccaaatgtcatcagtatattgtggtccagatgtattctaaataccaattgaaaaacattcttaaagctaagaacacatgacatatttcacaaagtgaataactgtgagaagcttgggaattgtaagcattcttgaaaaactatttttttttttgcatgtgtgttacaagcatttgcacaggttatatattttatagctctagttataaaaatagagaatagattatattccctcacatttgtacaaaatggtcagcaagaatacacatctacagaagtttaaagtatttactctttttttagttaatacatgtttcagaaccttaaagagagcaaatcataatgcccattgattataatgtcacattttagttattacattattacatttacttattataacttttagaattttaggaggaaaacaataattctgagtggaaatttgaatatttgcaccctaaaaattttcaattccattttcaataatgtagtagaatgtttcctagagacataagacaattaaaaatatgaagtactaggttttcaagtatattgcaaagccataaataatatataatctagcagtggtacaataattaatatattatttttcaattatattaagttttaagaactcaatgctcctaaaatttttaaataatactatataaaatacaactcaaatgatatcagctcaaattcatgtatacctctttgcagctaaagtcttttaaaattaaaaataatttaaaattttgtcatacatttatgaacccattttaaagaacataacatgtcatgcaaatgttaatttaatacataatgcattagtaaaaactgttctgaatatatatatattatgtttatgttagaaaaccatttttaaacaggaattagattctattgattcatcaaattattaatcacaacattgctaaactcaatttttactctcctaagcatattggaatctaggagaatgtacagtagagataataatatgaatagaatttaacttatatgttttagcaaagaagaaataaaaactggaaaattatgggtttctaacatgtctatttgttagttgtccttttaaaaatttctttatagaagcattttgagtgaagcccacagattatttaataatttattaattattcaaaaaagtctgtccttgttggcaatgtggaaaaccacactgccaacagagcaatggtccccgcaccccagagcaggggtcccccaccccaggggctgcagaccagttacctgttcatggcctgttaggaactgggcctcacagcaggtggtgacctgcgggaaaggtaatggtgggtggcattaccacctgagctccacctcctgtcagaactcagagcggcattagattcacataggaccaggaaccctatggttagctgcgcatgtgagggatataggttgcacactccttatgagaatctaaaactaattcctgatgatgtgaagtggaagagtttcacataacccccatccccacaatccactcacccagccatccctggtctgtgaaaaattttcttccacaaaactggtccctggtgccaaaaagtttgaggactgctgtgttaaggtgaaaaagggtacatgtggtaattacaaaaaaaaaagttcaataaatataggaaaaaactctaacatcatatgtatatgtggacatatatactaacatatacatgattttctgatttgaagaatgtataaaaaatgaggaaacgacattgaaaccctttttaaagatcattcatagttaaatataaatatactctcgttctctctctatatatatttatatatgtatatataataaatatttatatatgtatatataatatatatataaattgtatatataatgtatatataatatatataaattatatataatgtatatatattatatatatctataaatatatatattatatatattatatatatctataaatatatatattatatatattatatatatatacattttatgtagacagggtctcactatgctgcccaggctggtcttaaactctagctcaagtgatctgccagcctaggcctcccaaagtgctgggattacgggcataagccactgcgcctggcccacagttaaatatcttaagtcaaaactgataattgtacttcctttcacttcttctcttcattcttgaaaggaattcaacactgaaaaagaggtggagacctaactgaggcattcacaaataagaactttagaaaaatgaaaaaacatagttatataaatcatttctaatgatttgttcatcttcaaaacataggccaatatttctattttacccaactttactcagctgtaggatgcagtccagaaacatcttagtgtaagagtatttttcataaaatgtaagatattttatttaaattgaatggctgatcaaccataagaattccactgtaaagtaaccaaagaagtacaattcttagaagactatcatgaaatagttttatgaattaaagaaaaagtaatcacttctcaccaggaatcaaacttttagttggcatagcataaaataatttctcacactggcaaaagaaaaacctccagaaactgcaggcaaatgtcctctccccactcccactcctaaataaaatacgggctggaccgaggcattatgatttctcctgcctcttggatttgctctctgtaccacagagctgtcttctagtctaatcccactcataaaactgagcaaatggcataccaagaaatggcataccaagacagagcatctaacatgtgtttgacatttctgaagcatctcaagtccctggattccgcctcctgttttccatattttcaaacatgttctcgaacatgtgtttgacctttccgaagtatcgctagtccctggattccacctcctgctctatatattttttaacgttaatgtcctattctcattgttaaaatgtgagtttctacacaagttatttcttatttgtacccgaagactttgaataggctctggcactcccagacacaggatatcaaacagattcaggccttaactaggtcgtaggactggacttacatacaagtggctgtggtttgtgagactaggttgtagtggtttttttgttgttgttttgttttttcattttgtctaaggacttgaaaaccttcaggggagacgtgtgttaagatttgtcttcttctagtgatcttcttttaaaacacaaatcaatcctgttaaggaatccattaaatcactattagtgtgaatggatttttttgggtagtatggatgaattcaatgtaaatgcaaatgtagtatgtggaagaagagccattctcattctatgaacataggacagggatgagaatatatataacactatagttaatgaaaaatatatatttctgatttatgtgaaatcaattcaagagattatatatacatattctatagatataatatgattttcatcagagcacagaggatgaagagagaagagaaaagataggagtggtggctactagatcctcttgggggattattttgaaaaaggcagtctttggcaataaatgggcactaacaccttctaatagatatccattggcttgaagaaaaaaagtgtcagaaaatttatcattggagaaaagtcaatgtttccattagtattaatgtagctaaagatggctcaagggtaaaattattcaaaatactatgcatcacaatagtggcatcctgtggactactctctctctcaccctatggggaaaggggctatgtgaaaagaaaatgaatttctagagcagcaaaacaaaattctttatatttttttacatagaaattgattgtgtttgccatcagttgtgtaattattttacaaagaagcccttgaactgtggcagaaattctggatgctctgtcactatgtgtcaatctcaatatatcaatcataatgcctgtgatttgtggttaatatgaagcaaaaacaaacttctcttaggttaagtttattttccgagaattaaactagtttcctaattttttccccagggttccaaattcttagtgtaacaccaaccaaatatcaaaagagattattagagcttcaataaaaaaaattaaagaataagcttataattcacattattccattacatgcattattagagaggacgtttcattaaagcatgcaagctgcatttttttttaatttcgacatgtagatagtttaaactagaagccacccgacactttgatatagcataagacaactgggaaatgtcagttgactaaagtggttatttaaagaaaataagcaaatacaatattctttttgtctattgatatgtgatgctgcactgttattgggcaaactttttaattaatagaaaactctaatgcttatgatgacaaaaacatgttctgtaaaatagcactgtatatgaaaatagtacaaaagggggaaattagaactctgacaccacagtgtcaatgaacatcacacagattgaagaccacagtaatgaatgaccaacatcgttaggctggaaagagtgggaaaaattaagaatttcatgtagatgttattttcaaaaatagactcaataaaatgaccagactcaccattgggttcagaacgtgatcaatcatctctttcacttttatgttacctttgtgaagttttattaatggaaatgaagaaatttactagaaaaaaaatgattgtaggcactgttaaatttactttctctttgtgtaatttcgtgaaagtgacctgaactgctttgcatttgtagggaaaaagataaatatgtaaatatatgaaattaaaaggtgagaataaatttaaaaagtttttctctctccagtgagaaagtgataatcataatgtttagttaaagctatcatctaaccaaagccatcagtacactgatttttttttaacttaagattttaataatgctgaagcatttctgtcacctcagtattagtgcttcctggtttaaatctcaaagggccaccatccaaggctgcaaatatacaaatgataaaattttggtatttgagaatacccatcttctaataggacagccatgacaataataatggcattgatagaagaaaacaagaaaatttcaaaaagataaatactagggaaagtttttagattaacatgcaagtatgacaccctccctcacaaaaatcaagttcattaacactaagcctgtaaatttcatagaatacttcttgaactagcagaactggaatcacccatcctgttagatatgcaattaattggaccctcttgaaacagtatcttgtgtgttaggagttgtaaatctcaattgttaagcatcttcaggcactaaactttgagaaaaactgttctagagcctggaactaaacagtttatttgaaagtcaatagttacaaatgagatctgttcttccctccttgggattctaaagtcttttcaaagcatttaccaagcaaagaatctgccctttgagataaacctgctcatgcagatttaagataaggttgatttccgctgaagataatccatcttctacacacacactctctctcatacacacacctctcagatttttgttttatttcctcctcttctacactgtcctaattctccttaagtactgtccatcttcctaatttagtcctactctcaccactttcgtggtactctggtctccctatactctccatgtcctccaacacacctggttcagcaggaagcctaggcatacgtagtatatacccaggaaatgtataaactatactgtcagaggattaatttattttaattcagggcaacccaactgtgagctgccctaagagaaagaatacaagtaacaagggccattgcacagagggagatttaagttcagactggaagctacaagtgtacagaagcaagagagagagaaagagagagagagagaataaataaataaataaataaataaaataaaaaagcaagcaagcacaaagcagcagcagcagttcaagttccagattccactagttgcagtttaatgtaaagggatccttgcagaggagagatggtaatgttagtaaggccagatcttggatcttgcctcccactgctttataggatatcccgaaatctacagcacgcatgtgtgaaaaagtggataaaaccgtctaatattattctattcccacaaatgagatcagaaataaaatgtacagtagtgtctttatggaaccaagtatttcaagatctgaatactaacgggttcatttatttcactgattactgtatgtagatatgaaattccaggcactgatttttcattaaaccactctcttaaggttaacttgccgctctctttacacctatgaatccatatgcttgccacgtaaattgtaatattgatttttaacatttccccacagttcaaaaatattgtttgccaaaaatcaagggccttttctaacaattcatgtaattcctgttattagctaatgtgtaagagttgggaacaattaaacatactgtatacaaaatcttaccatgctgaattgcacccaagatactagttcagtcatccttcaaattacctcacaactaaaaaggatcagatacttaaataaaaactttaggcaaggtaggaaagaagtcttttatcatccctgtatattgcaaaagtgttccattctctctaaattcacattatatttattaatgagcagcacatggaaagaaagaaaatgagagagagagaaagaaggaaggagagaaggaagagaagataaagaaggaaagaagtcaggatggtaggaaagtgagagacagaaagagagctagagctagagataacgatgagagagataaaggagagaaactctaatgtctttgatatcctccaacttaaaagagaaggatgtaaccccccaccccctccccgtttacatataatggaacaagccaagtctccattcactacatgtggacattaagaaaacttgcatggggaaaacttttggggggaaatgaaggtgatttctgagctgctactgcagttgtatatgacactgacatttatttcccataattcttgcccacaggaaacacaacctttaagaaactgaataaaatcaagttggacattctcaaaatctgcaaggtatcaacttccccgagaagctcacattcccccaacacaaacacatacatgtaaggagcgagacattcaggcgatgagctttgaaaggtacttccaccttgtgagggtgccacggatttggttgttcctgaacctgaatctgaaaagcgggggtggggtgtgcgatgacaaatgagggtgagaagaatgtttccatgaaaccagaaacccttttggaatctgggctgagaatcaggatcccacccccttgcctacctccaggctccagtaagcaaccgctggcgtcctcccctctgctccttcagcagcagcggacgtagggatcccgagcagccacggagcttaggtcccgcagagagctcctgccaagcgcttctctctcgactagttaccaattgagaaaaaaaagggtcagagacacacaaggatggtgatcaaaatccagtgtcaggcaccagggtcccagaaggttccggctcctcttctgcgccttacccagctcttttcgtctggcaaagggtcacccagcgagcccccagcagcagatccttcccttttgctcctcctgatagcgccaatcttcgccgccactgccacactgcgcgcccgctatccactcaccgcacagcgagaaggcctggcggagatagcgcggggggaggagggtggattaaaaggatagatttttggaagggtaagggagaaaaactttgatgttgtaaccacacacaggactgagaagaaaccaaaacaagttgcagcttcaggagcggggaggacgcttttcggggtaaaaaaaaaatcaccccctaccaaaatcagggggaggaagctccctgctccttgagcgatcacccagagcacctcgcaatctctgatcttcgaacccactgaaaaagcacagggcatggggagtcctgttggttcatgcccagggtacgaataccaaaagcgcctcccgctggagaggctgcggggaactcgaggcaaagacagaggcaaacgcaacgctgggaagagtgaggggagtccgagctgccgcctgcaaaagcagagacgcgtcgcccttcgggcaaagtgactgctacaaagtccgttccctcctgcgcagggacagagacatttaaaggcctgaatggacgtcagcaccagtcgagctcgctgggtgagcgccaggtctccccgccccacggattgtagcgcgcacagggcgatctgctgctcgcgaggtagagtggcttacttggggagaaaacagagctggtggcgctgcggagtgtcaaaccctggagcccatcgtcaagacgttatactggtggcagttctgctgtgagtgcacttgccgaattaaaaagagccagagctgcgtggagaggggtctggccactctgcgcgcgcgcacccagtattgggttaccaaggagctcaacacctggtttttagaaagaaaaaaaaaaaaaacactttctctttagctctggtttgagtaggtattctgattcgtttctcaaggttagttgaaatccatcgagatgtcttttacaagaaagggattagactttcctgtcttgaaattccaatcaagataatactcaatctttccttaacccccactgtctacttcctaactcagagtcacagtggatgaaagtattcaaatgtcttcaaatgaccattaccctgcattctaagacgatttgcatacttagacgccctttagtaactttaagagcctttgcacaaggaagttgtatttcttatattaatacccttctataagtgatattttctgaggattctgcaactatttccagatagacaatgaagaattaaattctaaaactcagaaatataatggaaagtggatttattttttcctgtctaaagtgatcaattatgtttccaacttatttttacgtttttgcatggtatatcagctattacttaaagccacagtatcaaacagaggtggaaaaaaacggaattcacattactgtggtcctttcctacaattcctttgaggaaatacgtgtgtgtgtgtgtgtgtgtgtgtgtgtgtgtgtgtattatctgtatatcatatgtatatataaaatattgtctgtgctattaggagcccaggttctgtgctgagcaccttgagacttgttgtgtaggaagtagtgaagaatcggtaaacagaatagagaatctcaagaccaaaggaacccgtgaaaggcagttatagctgtacgttttttccttgtttagttccagcctaaccaaggtagggtcttccttgcttagtcacttgaagcctttcaacagtgacatcagcttaacttaataattccacactgcatacaaatatcaaaacatcagaatgtatcccataactatataacagttatgatttgtcaaataaaaatagtatttttaaagtgacataaacacaaattctgccagacagcagggtccatatttattcatttttgcacaactgcccagcggccctccctctagcggcggtcaaggagtctgtctctctctttcacttggtgtgtgtgcgctggcgcgtttatgttgggaaggttgatcactaagagagcttacaaatatctgtaggctctcctgtgtaacctccttctcttcctagccagggccattcaccggtaggctctcaggcgccacttctagagcatcctctgatgttggtcctgaactgggagagtctgaccaaacttgacgaagaggactgtcaaaaggcgttagaaacttcggaaactggcaacagttacggcatttttgctctgcgaagaatacgcccagaaggttcagaaagaagtcgggagtggggatggggagaaaaacattgaagggctatggaaaagcgtcaataacataaactgactttaatttttcttcatagaaatgtttccggtgaaattttctaagaaatcaggggacagttaatttgcttggttgacgctcacactccttgctctcactaagtctcaggtcttccaagcctagcactctgtcaaaatgctttcgggttgagggggagggctttcctggattccgcgaccacaacccaccaccccaaaccccacttcccatgtccttgatttttgaggctttttgggagggcatgatttcagggaacattactcttggccagctcaggggagcatagtcggaaatcttcggttgtattcctgactcagcctgggtgcggagcgagcgcggacaggaaccgagatgcaaaggcggacgcaaccagcgcacccgcagacggcgcgcggcaagaaccaccttctagccctgagcctgcggtgccgggcgggctcaggaggctagtggggtattgtgatcactgggacatcaggatgaaggggtcactccaatcccttggagatcagattctcggggactccatggccagacccgaacggcgcccttcacatggtgggtggagagggtactccttggccgaattgacccctccctgtcccgcagggtcagccccgcgcccacccacacatccagtctccgggaacaaaactctgtctggatctacactgacccgttgacgcgctttcccaaaggaggaacgacaccaacaaaagcagaatcgctcgtgggagattttctaccaagaactgttacctccctccccgtgtaatcggtttccactcaaaaggatgcggaaaggacctcatcctctgctgtccctttcgattggcccgggactgggcgaagccgggagctgcagggaggggagccccggcaccccagcctctgcccaacctcccccagcacggcggccctcggccctcgtcaccaattcctaggcagaaaagcgcgcggccggagcgcgcaagtcttggcgtccggaaacaagtgttttccgctcagtcatggcggcttcgccagtcgaacagagcgaaagggctctgggcgaccctgcgacttccaccagaccgcgagcccggagcaccggcggagggtggccaaacgcgggcctagggctcccccagcgcttccgggcgcgccgggaactgcagctggtgcgccactgccttccccgcgcggtgcccaagagcgccagtagaaggaggaggtcggcacacctgctgttcctgcttccttcccaggaggccgattctctccatcccaactcgctccgtggctcctgcttgctcctgttccccctcccgactccccgggtaacagtcgaccttagggtcacagcagggtgggtactaactagcacacagttagcgtggactctgacaatccagggctcataggatcacgtttccaaaagcgccgaggaaaggaacttcccttgactatgcccagaaggatcaacttactgtgtgtttgcgatcaatcatagcaaagctgccttatgtaacctaagcacgtccttgcctttgtttttgttttttgttttttttcatgccttgacaagtcaaagaaacaagatttgtagtactgtgtagactaacaactgtttctcttctacaagataattaatatattttatttattttctcttctaaaatagtgaaaataaccttggtttaatacacataataaagtacattttaatactaattgatggattaaatttacaggacagtacatagtattgaatttccacttataacctgcttttgttataaaaataatgaaactcattttcttagatataaatatatatacacacacatatatatataaacttatagaaacaataagcttcaaattcacagtacatggcaaatatagtcaatagttctagtgtaagtcaaaagaaaaataatgtccttactctctctctctcaaaaactgtgtcagaattcaacagagcaattgattagaaaccatactcaacatatttattcacaagtagtagtaaactcagaaaaaaatgtattggtagcttaataatttatatttcctataaatctcatttcttacaacaacttttaaaaagtgccttgacaagccaagtatgttcttgaatatttgaacagattgtcttaaaatgtagatgtttttttctgccatcatcagtgattgtcatagcaaacagatgcaaatagcatctgcttccatggcagatgccaggatggtactagcatccttaaaatgtccacagagtctgtctggacagtgattagcattttgtgggcccactcgtgctgtgtcaagctctgcagcagtagtagagatactgttaaacaacccgatgttttatgattactaattatggcaacagtactaaaatataacaatgatcttaatgatatgcctcttcaaattatatttaaacatttcccaattacccttacactaactatagccaatgaacaagttaagaaaatttaggaggaatagataaaaagatgtacatttttaattgtttgtcccattccttcagttgtatttgtcagaaatactataactaacatttattgactatttcttgtttgtttagttctacatgaaactttttatgcacatggccacattatttcctaacaacaaatccgtgaagtcaggatgattatccccatttgtaaataaggaaactgaagctttcaaaggttgtaatactgtggacagattccaagagctggagaggcaatatgctgatcaaagtctggagttcaggatgtgattgtgataaacaaaataatggtctctcaaagacatctacatcttaatccctgggacccgtgaatttttaaagttatattggcaaaaaagaatcaaggttgccaatagaattaagattcccaatcagctgaccttaaaatagggagattatcctagattattggagcaggcctaaaatctggaaaagagaggcagaagaggaggtcagaatgatgctgtgtggtaaggaatcaacctagtattgatatctctgggtttgaagatggaggaaaggggcatgcatgggccaggaaacgtgggtggcctctagaagctagaaaagggcaaggaaacagattcaccctaagagaaggtcagcaccttgtggacaatatcaacccagtgagatctgtgtcacacttctgatctacagactaagataaagtatgtgtggtgtaaagccattacatttgtgataatttgtcacagcaggattaggaaagtaatacactgatgcagatctttttgagtcagaaaccgcattttaacctctgtacttttcagtcagtgatcaacctctgaataagaagaaggttatctacaaagaccaaataagaagcccttgggagtcaaaagaaagtaatctaggggaagtttgacactgattctatttctcctacactaataaatccacttacatctggcaaaggaactaggtaacaaatacgcttttatgtgccctctattgtcattttacaaaaaaatcacatataaattcaaatggcttatttatatgcttatttttctactctatcagtttgcctttttctttaaaaatatacttaaacacatgccttagcaagcaaagtaaaccgttaagagagcaaggctggtcgcgggggttcatgcctgtaatcatagcactctgggaggagtgtatccaaaacgggtggatcacctgaggtcaggagtttgagaccagcctggccaacatagtgaaaccttgtctctactaaaaatacaaagaaattagccgggagtggtggtgcgcgcctgtagtctcagatactcaggaggctgaagcaggagaattgtttgaaccctgaaggcggaggttgcagcgaacagagattgcaccaatgcactcccacctgggtgacagagtgagactccatctcattaaaataaaatagcagtcaagtgaaaataataactcaaaagtatggagtctggagtgaagttagtaaataaagcacatgccactaaacatttggtaacagttggctataaatcttattcaagttttttttttctataaggcaacttgaatagagaaatgtgattacagtatataataagatttatggtttctgtaacataaacctaaatctttttctattgatagggaaagaatggaagcaaagaaggaagaagagaaaatagcacccaatttctaacaacaaatttgaatctagtaggacaaacttatgttccatgaaactaaagcccctttctaacttataattattttatttttaatttaattttattttttgagagagggcctcactctttcacccaggctagagtgcagtggcagggtcaaagctcatggcagtcttgcctcctcaagttcacatgatcctcccacctcagcttcccaagtagctggcactgttagtatgtgccaccatacccagctattttaaaacatttttgtagatggggtctcaccgtgttgcccaggctagtcttgaaaccctgggcttaaacaatacttttgcctaggcctcccaaaatgttgggattacagatgtgagcccctgggtttggcctatgattagtttagatgtcaaaacactgagccacaaattatgaacccttctttttcatgagtaatacaagacagaggtaaaaatcaaaggatggattacatatgtactgcagcccatcctgtgttaccatttttttctttgtcttgtctttttgctatgttgcaataacagcattataatatttgggctagattgatattgctgtatcacacagacaaaatagatatttcaatatgattgcttctgatcaatgggcaaagagaaaaattagttttttcttcagaggtttttacttctcaaattattatttttgataaaactatgcttgtggtacaaacaatacctttcaaacagctccaagagtatataataaagtgtaagtttgtttttacattcagaacctctgtctcttattactttttactttgcttctactcagatcatatagggagaatagatcctacaattttcaataaatgtcattggtctgaacctggatcaagcataatgttgaagtgagctaggccgattggagacattccatggagatatttaataagagcagcaagattgaagggctacttttgttttcattctattgggaatgtgaagccttggagccacggctattgtgatatttgggagagtcttacttacaggcggtgggaatggaggcaaaggtagaacccaggagaaacatgaggctgttaaagacattagacttccttgttaaatatatctctgaggcgtaatagtgtcactttatattctgaagtttaattttatgagctaatagatactatccattcatctatttacctttctatttttctatcaactatctttctttttattcttctacccaaaccaatttaagttgaatttctgtgattttcaactgaaagagacatgactaatagaaaaatactagttacacaagtccatccttctaagataccatgtggcaaacaaaaggctgagtctactgattctggaaggagcaggttggggtctaagcagcagaaaaggtctcttggcagacacatataggtaggggcacaaaaattggactgcatcagatggactgaaccccaatcttaatggcctgaaccccaatcctaatggcctgatgaggaaatgaacattatattcagtgtgtaaatattatttgccaagttttccattgttcttgtatatatatccaggatacaatcacaaaatataaactactatattaggaaaaataagaacatatattaatagtatataaacaagacaaaaatgtagtcattgatgcagatgcacaaaggatccagatattggagttattacataaggactttagaataataatgatgtatttattagaatttattgctataaaaagggaaaactatgtgaacattttggggaattttctagaacattggaaactctgaagaggaaatacttagatattctatagcagaaaggcaaaaattaagatgtcctttcattgggtttaactatggactgaagttagctgcagaacttaccagttactttaaatactgatccataaaaattaatgcagaaacacaaaggtaaaaaataataaaagtgtctctgatttatagtttggtggcaaaaggaaaaacatagttctaattggatttcaggaagaagtagagctggtgagtaaagacatattagatgagctaatacctgagaatttcccaaacattgaagaagttcagcaattcccaaatagaactgatataaagaaaaccacactgaggtatacaacttaaaagcacctacagaatatggaaaaagaaacatcgaaatgagatatttggcttttcatctgaaacaacagaatgcagatgtttcccatctttcccctagtaattccgtttccctgttatctttaaagtgctgttagaaaaatagtcaaatagaattctgtatttttaaaaaatatatcattttacaatgaatataaaatctttccagaaagagacaaaatgagaaaaattatatgttcagcagatttgcactagaaaaaaatattaaaagcattgatggtaaatgataccaaaagaaacccaaaacacaggggaaaatgaagactgctggaaagggaaaaggtaaacgtataggtgactacaaaagggcattttactataaatttgctaatttcttaacatttatggagtatttaaagaaaacttaacaaaatgcatcatgaatttataaagcatggagatataaaatagaggataactaaaaatacaggagtaagtagggtagaattttaccattgaaaggtttttactttcttatagtggtaaacatttttgaacaaggactggggtcagttaagtatgcatatcatattgttttgtaacctttagaagttaagccaaattgatatttaaaaaagtctacagagaatataaatttaaatgcttaaagtatttaacccaaacgaaggtaggaataaagaaacaaactaaaaaggcacaaaaatagaggcacaacacattgaaaaacaaataagatgacaataaccattttcttggccacagtaaatattaaataactaaacaattcaattcaaagtagagattttgagccaggcatggtggctcatgccagtaatcctagcactttgggagaccaaggcgggtggatcacgaggacaggagtttgagaccagcctggctaacatggtgaaaccccatctctactaaaaatacaaaaattagccggtcatggtggcagacatctgtaatcccagctactcaggaggctgaggcaggagaatcgcttgaacctgggaggaggagatggagtgagcagagatcgcactaccgtactccagtttgggagacaggacaagactccttctcaaaaaaaaaaaaatcagatattttcaaactggatttttaaaaaaaagctttatatattccatatataagaaaaatagcttaagtataaggatacagccaagaagaatgcagaagattggaaagattataccgtgcaaacagtaaacccaagtccatgtgactatattaatgtcagataaggtagatatcaagaaaaaagagtatttcgtgggatgaagaggaacaccaataaaaataaaagatcaatatttttatgaacccagtggcagaaattgaaaatacataaagcaaaatttgatagaaataaaataatatactgaaatgtagctggaattttaacacctttctctgttagtaattgacaaaaggaaacaaaatataagtagagtatagaagatttcaacatgatcaatcaattttagctaattgacatttatagaataatattaccaacaactacatagtttgaatttatttatttatgaaacattacccgtagtaggttatctgcagagacataaaatgtctcaaaattttaaataaataaacatgacatagagtaaatttttaaccacaagcaattaaattataaataattttaataagatatctaaaacttcaagaagcatgaaactaccatgaagatatttaaaaattatgtgacactcttctaaaactgtatagatcaaagaactaattgcaaggaaaatgtgtattttacacatatatatgcacatatatatttatgtatgtatatatatacatatgtatacacacataaatatacacacagtatattttttaaacaaggtaatactgaaaacatgatgtattgaatgaaaacatatgtgagagtctgcccaaaaaatgattaaagagaactttaatgatttttccaaagtttttattctttttctggtctcttttgcagatacagttaagttctctaccctcagattccactcttggtcctttgcctgttttatctctgaatgtttcccatctttcccctagttattccctgtttttcaggggctgactactgcaaattatatttcttcaagttcgtttgccaactgacttcagatcagattcagtcaatgaaagctagtgtgtaggagattggccggtgcccaaagagtaacagctaggttgttcctcctactttgcctcggctatgggtagcatctacaccattacctgtcctctaaatggttctagcttccatcagggaaccctggctccttgtctttagtagcttgaccttctccctttatactttcaacctgtttctgattataatttgacttctcatatagagtaatcagagggagacaatctaccgatttcaaccaattactattctctatgatatattttatttatttatgatactataagactgcattttatgtgtgttttaagcatgagtcagcccctcaaaatttgacaaaagcagcattggtatcttccaaaaggaaggtcagatcctgatgtgtggtaaactaattaacatgagatctatgacctaaaggcttaaggttttactttgatgattgttatttttataattctgagtatcagtgttcaacatatttgatggctatcctcatcaaatgatcctaatttatttactcactcatttatgtactctttgaaaatatgtattgacatcttctgtgtccctatcctcatacatatctcagtcttgttgcaacagagaaaagcatatggtgaaacaagggagttggcccattcttgacaacttgtgcagatacgagtgttttgaaaggggaagaaactgggaatgcaattttcttagtgtggtgagctattctgcaatattataacagattcaatatttaaagagctgcaactcaaaatgaataagataaattgaagtgttgtgatttaagtgcaaattaaattctcaaaaacattcaaatataggttttgcctgtaattaacaaagcaaagagagagtgtaaatcttatgtggtgattagactggtctatggtaaaactgtggtagctggtaatttatttttctatgtcaggaaaaaaatggaaaacaaatatagtaaacagcaattaatgttttatgatttgtaagtaaagttatatttttaagattgaagcctcgcttaccattctcaaagagccatttcaagccttgaatctctcagggcttcagtctgaattattataactttccagtttgagaacatttttcatttattcaacatttaaattgtatgatattgtattttcaggaacaattatgtttattttttatatgaaataaaagtggacaaaatattaactgataattttaaaactattataatgacaaatacaaggcatatcataattatgtgtgaataaaaagagaaatgcctgtaaaattataataaatcattcaaatatcttaaaagcaaaatgcataaaaggtagaatgtgtatattttcaattgaatgaccgttttttaattaaaagaaataagaggattcttaaaacattcaattagaaactagggattttcagcttttcccttgattctattagaaatgtaaaacaaaataaatttaaattcaaaaacatgacagacccttcataatgtattctctgcctactgattccatgtcacttctaatttctccctccatacaaaatatgttgaaattacactaaatctttgccttctgtgcttttattttaacacactctatcatctttgcagttgaaattttctctgttcatataacttgccttctttcttccactttatggtttagcatctttttatctttcttggatcatctaaggtttagctttcttgtggaaatctacattggctgcacttcctagatattcccattgggccttgagttcctcttatagcacttcctacactgcgatgtgttgccacgcttactaacatagctaacctattatacagtaaaaacagttaggggacagttagggtaaaaagactaaagtgggtaaagttagggtttgggttacaatactagttgtatcttgatttgctagcatagcatacatactagtcaccaagtatatatttattgaatatatctataaataaatcaataataacttttaaaacatggacctttggtttgtatcttataaaaagcttctctaaaatatatgaaagttctcactgactttatgaaatatacattgctctgatttcttatttatttttatttatttattttgagaaagagtccctctctgtcacccaggctggagtgcaatggcgcaatctcggctcactgcaacctccatcttctgggttcaagcaattctcctgcctcagcctcccaagtagctggcattacaggcacatgccaccacaccaactaatttttatatttttagtagagatgggatttcaccacgttggccaggctggtctcaaactcctggcctcgtgatccgcctgcctcggcctctcaaagtgctgggattgcaggcgtgagtcaccgtgtccagccccttgctttgatttcttagtcttcttaagctctggtccttaatatttgagaatgtctggcaggatccatgaattttaaattttaaaatttgtataagcccaaaatttgcatgcagtttgcatggaattttgcaaaatgtatggaaatcctgaggtctggcttttttttttctttttttttttttggcagtgtctcattctgtcacccaggctgggatgtggtggtgttatggtagcttactgtaaccttgaactgctgggctcaagcaatcctccaggctcagcttctgagtagctaagattaaaggcatgtgacaccatgcccagcttattttattttattttttttcagagacaaaatcttgcattgtttcccaatctggtctcaaactcctgtcctcaaagtgatcctctggtctaggcctcccaaagggctgggattccaaacatgagcggttgtgctcagccttgaggttctggctgtaatctggctgttatttatggaaacaacagaagttcttggtattaccagtcattcttcttgagacagtcaccccacaagactgagatgaatatagttaagaactgaaagtgaggtcattatggcagaacagaattgacagtgcacattaaaagacattacacactttgggtgattcaactaaatcatagtctaaaatgcagttacaaaatggtaatgttcaaaagatcatttattagtcaaagttacaagaagggtcctggttatgttggtaaaaattgaggtatctgtgattatccatcttcaaattatttgttaaatgcttattaagataaaaaagttacatttcaaaagtatttatattattcgtcaattcctgcataacaaattatcccaaaataaagtataataataaaatttaaaaaaaagataagaaacatattcttcatgaccaaaaaaaaaaaaaaaaaaaacagcctttattatctcaaagtctctgcggggcaggaatctgggcatggcttatctgggtcttctattcagagactgtcacaagttataatcaatctcactcacatgcttgttggtagattcagtactttgacaggtgttgtccagaattccatataatgtgagcctctccagcatggaagctttcttcatcaaaatgtgcaaagccaaaaaaaaaaaaaagccattgaaaagagtcaaagacagaagtcacatcttttgtcacctaatcacagaatcaacatctcatcatgtttgctgtattctatgcaatagcagcaagccaatagatccagctcacacacatggggagggtattagacaagggctggaatcccaggagatggagaccattaaaaactatgttaatctgccgattacagtagtttgtcaaagaatcctgagataaaaattctgggctcaaagttcttataaggcacttaggcaggacaataaaggaacagaaaatagtactatattaattttactgatttactaatactaatatactggtataatgtactaaaacagtatactacatttttggtaatttgttccagaagtaatagaaaaaaatccaaatattaaatgttaaagcatattataattctgtgataattaactctgtaatttaaaaagtctaatataggaatatacctaaaaagaatgctttaaaaatatactttatttcctaactaatatatcaaaatggagccttcacatatgaaattagtaaaatatttttgacctaataatttcatttttagcttttcactaagaagtaatattgtttgaaaaatattatgtaccaaggagtttaaaacatgcagttgtagttaggtaaaatttaaaattaaaattgtgcaataaatgtatgtaaaaacaaaataatataggaatctaaatagccctatataaaaaggcaaacataaaattaaaaattagcattaaccaaaaatatgctctgaagtatgtcccctgactaaatttacttaatttagtttcttttggaaaaaaatttaaataattgtatttgctagtaagagaaggtagaccattatttgcccatttgttatcagaagtaaaacaagacatttatgttttcagaagtaaaacaaatacaatattttctaagtaataaggttgagacaagaaaaaaacagcaatgagtcaaaatgtctatttacatgcttttacaggaaaacaagacttagctactttcttcccaaaaaaaagaatttaagtagaaatgttattgttttactaaaagtaaatacattttacatacttctctcataattttaatctggagttcagttatggtgatcatattagtcagtgttttccagagaaacagaaccaataggagagagaaagagatggggagatgaaataaggaattgtttagtatgattgtaggggaaaagacatcccaagatctgcaatcagcaatctggagactcaggagagatggtggcatagctccagtgtgaaagctggcaggcaggtttgacactaaataaaagccaaagtttcagtttgagtccaaaggcaggaagagacctatgtcccatctcaatgcattcaggtaggaggaagttccttcttacacctaggaaagtcagcctttttattctattcaagacttccactgattggatgggacccatccacatcattggggaagtcttctttacttggtctacgaattcaatacagaaaaagatatacataagacatcatttaaattttttaaaaatcatttctaatcaaattgtagcattttaattttgtttttagagttttgtaagtgtccttaatttttcagcttattcttaaaaaatcaatttcactttattcaaaattgccttttggaaaacattaaatggtggcccatataatcttagactttacatgctttttgataaatataacattaaaagtagcttgtgtagcaatttaaattacatatataagatgtacatatattatcctccagaggaaataaaaccattaagaactctgatttagtcagggttctccagagaaacagaactgataggaaacgtgtgtgtgtgtgtgtgtgtgtatacatatgtgtatgaacatatatatgtgtgtgtatatacacacatatatacacacacatatgtatatacacatatgtatatacacacaaacacacatatgtatacatatatatagaaagagagagagagagagaagaagaagtgaagagaagacatttattaggagaattggcttatctgatttcagaggctaagaaatctcataataggccatgtgcaagctggagaaccaagaaagttgttagcgtggctcagtccaaattcagaggcctttccagaccttaccactaatcaacgcattatatttagaaaggtatcatagtaagtctgtatttcaatttaaaattctctattttcggtgacagtgaaggacaaaggggcaaattttataattattgtgaaaagagattatagagaaagggcctggataataccaaaaatagaagaaagaaccatccatctgtggcagagaaccagcagtgatattacttgaaatatggaaattaataatatgtatggttgagtttaaggtctaaaacataaaagttaaacctaaatctaaaatatatgatttaactctctagaataaatctactcaattatatgaaacaagcagacttattctcaatattttatcaataataaaggtttttccaaatagtattgaagaaatagcaaggtgtcttaaaaaatggccttagaccatgaaccatagagaaaaagacaaggtttgccatgaaaagtgaataacctttttatttccagttgtgatgtgttcatacaaaccattagcactttcatttcagtgaattatgccagttcttgctgtaccttgtcaaatgagccagttaataccctaaatctaaatgaaacttttctcccttagatgaaaataaaatgaaaaatttatctaattaagttcagacaaaatataggtcatgcttttaaagattttaaaaagattaaaatgtcaggcatggtgttattcccaggattagctttggcctatacatcattctgcaatgatagaaacatttgtatgctcacaagcggcctttgggcacttggagagtgaccagtgtaacagctaaggaactaaaatttcacttttcaaaattttagctaattcatatttaaagaactctgtgtggctagtggctaccatattggatggagcaattctaaatgaatgaaagtggttgaaccctttgtcaattttagtgcctttgactattagggcagatggtaactagagctttcccctttcatcctccaggatgttgaaacaacatccacctctgctgaaaatacttctgtctgctgcatgaagagtgctgcaatccagctgagcaaaactaaaatatcattgacctctattgtttgagagtatgctgatatttgttcatcgttttctaaagtattaattgcatgtgatcttgagtataaactggtgttgaacagataatacatttgtgaatgaggcttacttttgcgaagtagttgcaggagtttgtgctgactcctctctattcttcgcaaagctggcctccttttagtgtcttccatctcttatttttctttaccttaaataaaaaacattcctatgttacatttatggttcataataactatcgtgcttattttctacaatgtttctattatgatgattattatgttctttgctataatagtaagattttataaatgaaaaagaaaataggtagcactgagtaatacttaaaattaactagaagacaatttctgaaactttgtgaattggcaaatataagacatataacctagctaaatttaagcaacaaatacaaaggatacaattaacatgttagaaagtatgtgtttgtttctttattaattggtgcagttgaactcttcggaaaaattgcatctcccgaaaaactttgttttgtagagtataggaggactagtgcatccatcctgaatatataaagagctaatcttctggaagagatatgacaaatgttattcttgtgccaataattaaaaagaaaaaaaaggaaaacgtaagacttttaaaactaataatctaggatcaaatattaaatgtatgacaagtgcagatgatagcaatgttctcatgcaattatgtgtagcataaaaatttctttaagaatgactttaaaaaataatagaacatctgtgcaataccattgtataaaacaaaaaatcaaggaatattcttgaaaaaagtattttaattattattttcatcaactctacaattattagacaattatgtaattgcaattcattacattttaaaatatattgacattttattttctaatttgcatgtatttcttgaacatttccagttttattaatcactacttttgctaacattctacgaattgaacttttttgtggctgactttaatgctttactgtcttcacgtaactagactggactctcctttgaaaatatatgatcgacataagcaggctcatctccagatagaggttatttattggcatttcgaagttgtttgagagttgttattagaaagctatggaaataactatctctgaattgtccattgccttcaggaatcacttgtggaatattgaattgaataataaagaaagagaactttatcaacttcttatcaattttttttttgaggcttagttttgctcttgttacccaggctggagtgcaatggcacgatctctgctcaccgcaacctgcgcctcctgggttcaagtgattctcctgcctcagcctccctagtagctggaattacaggcatgtgccaccacacttggctaattttttatttttagtagagacagggtttctctatgctggtcacgctggtctcgaactcctgatctcagctgaccttcctgcctcagcctcccaaagtgctgggattacaggtgtgagccactgcacccggcccccaatctacttttttatagatgtgaacgcattgcaagacaaagcacaaaaaatgaccaagaaaccataaatagaacattcccacatggccaggcatggattaaagtctaggatattgaaggtcaggcatggtggctcacccctataatcccagcacgttgggaggccaaggcagaagaatcacttgagctccggaggtcaagaccagcaaaacccccgtctctaacaaaaatacaaaaaatcagcctgacgtagtggtacaagcctgtggtctcagctgctttggaggctgaggcaggaggatcacttgagcaggggaggtgaatgttgccgggagacaagccacacccactgcactccagcctgggtgagagagtgagactctgtttcaaaaaaaaagaaaaaaaatgtctaagatactgggagttctctgccactcttccctgtttcatctaagatttttagtacaatctcctgagtcacacaagcaataaggcgccactatttctcttctaaaaataaggatgtagtgcaaatgcttccattttaaaataattgctctattaagtgcccaatttataccttcttgaaaggttacctaattgcttcagcatacatttatcactgtcttataaatatttttagcactgatttgaagttacataattgtatgacctgagttagaaatgtagttctgcttttaggtattcatttaaacaactactatttaatgaatactgagctgttttcattaaaataagagttatttgatatataaacaacaagaggaaatggatccttcagccagatgaagaattgattcatacattttaaaattgggaagtgcttggcactataacttgatggtcctgatgaaatatgaacttgtacagagaagcaacatttttcacacaattactatacattcaacattgtgcttgctgatgaggatgccaaataaataaattaattaattaattatcactttttgaggattttctgggttcttgttagaaagatgaaatgaatatgtacaaaataattttaaaattataaagggcatgattatatacatattacatggaaatttggaaagacaatattaatgacaatttttgtttatatgccataaaattaaccctattgcagaaaaaattatattataactataaatatgtaactatatagcaatatatacagtctatgactttgttttgtatatctatatagctatctgcatttatgactcttggccagttaaacctagtctgttttctcatgttacctgtaacatacagccacaatatcaatataacaatactatttactattgttctaagtttaatatctttccaattcaaggtcgttattgggtccaaatgtaatgttctaacttagtacatttggaaaattctttcctaacgcctctgggaaaacacaaaatattacttacaaaaataaatgcataaaaatgattaaaacctctatataagtttgggtgagtattttcacattgctataaagaaatacccaagagtgggtaatttataaggaaatgaggtttagttgactcacagttcagcatggctggggaggcctcaggaaatttacaattatggcggaaggcaaagggggaagtgaagaccttcttcacatggcggcagaaaagagagagctagcaagagcaggaaaaactgccttataagactatcagatctcctgagaactcactcactatcatgaaaacaacatgggggaaaccatccccaggatccaatcacttttcaccttgtccctccctggacatgtggggatcatggtgattacaattcaagatgagatttgagtggggacacagagccaaatgatatccacggccttaggaaaaactattgtatgattactctatttagatgttttaaatgtcataatttgtaatgtttaaaatatgttaattacaaataaacacagaaaaaataatgactacaatgtatttttataaagtcatacatagaattcatgattaaagtggaaataatattgtggatttaagatcaaacaatattttttgaaaaattttgaaactttaattattattatttctctgtgaaacatcaatattacaagagaacaaagagaggaaaattcagtggaagtaagtgttggctcatgaattgtaagttcagttgtaccttgcaagattatattattggtattgttaacaccactcagtaaatactttcttttttcaaacacaggaagacttgcaatctggtagctattgcttctgtactacagataaattaaaaacaaacaaaatttgaggtcagcaaaactgataacccttgataaaatttccaaagttctcttacatagttcaatgattttcttaactaccttctcaaggactcccataaattaatccgaaataactgtttgaatactatttatctcaatatctttgttcttgtgacttatcagagaatgaaagatggtaaaaagaacaataatatcttttaatagtcttcagagtaattttaggagatgaaatataattttatgactttttttactttttacgaacatatggagatatatacacactaatacaagtttcaaatgtattactgaataactgattaaacgtgggttttgtttacattcttttaaatgagaattaaggaaagaaaaaaatgagtgcttcttcatacctacgagaatgcctaaaatgaaacagaaggaaaatacagaatgttggtgaccacatggagcaaccagaactctcatacactaatagtgagaatattaattggtatagctacttctgaaaattgttgagtcatatctactataggccaatgtacatactttctataaatcagacatttcttccccccgaagcatatactcaacagataggcacacatatgttcaacaacagcagcaacaaaaaagaaactggaataattgtaacagacttacctgtaatgacctaaaatggaaaattacttaaatctccatcaagaacatacagaaattgtcttatattgtaccacagaacactttcgagaaatgaggactgatcatgcaccattggacacaaaatacgaaggaatcttacaaacatgttgttgagtgaaataattcagtaacatgatctcatttgtatacatttcaaaatgataaaattattcaatagtaaaataaattataatagaggttatccttgtgtggaggcagctagagatggaaggcaattatgaaggcagcagcttggttgtagaatatcatcggtatttttttctcaatatacattgtattttttaaagtgttgagccgtatatttataatttgtgcacattattgtttcaaagtaatttttctacaaaaacccaaccattaagactcagattttctaaaaagaaaagaagaaccagctacttttaatgttttcatgttttatcccagaaaaataaactttgaataagggaaggacaaatgggtctggcttaatatttgaaatgatgagaggagaaaatataagaaaaacatgtctatattttattaaattatggtagaaaaaaggcttttcaacactttacgcattcacaggttcatgagtaactttgtaattcacaatcaagtgttcaattacaaaatactggaaagttataacatgtgtttgtctttacgctggagtacagcttagaggaagttgatcagttgtgtattttaaaaatttatttattgtgtaaatataaaaatacattccaatacagagattcaacaaaataaatattcgtctgaactttggcttagaaaataattttgttttttcttcttctgtcccataatttagaaaatatgtaagtttatttcaattttagatttattgacattttgatcttgatttgcttgagttttagttattgaaattataattggaaatggtagattaatccaaaattagaaatttgattcatgtcaatatttaattaagctttttgttttaattgcagattcacatacacatgtaaaaataattcattcaaatcatgtgtatcctttgccaagtgttctccaataatattgttgggacaatgatattgctatagtcaagtttcaggaaaattccatcaccccaaatatgccacacgttgcagacatccttatcttattccaaatcttaagggtaaagcactgtgtctttcatcactaagtataatattggctgtaggtacttgtaggtaattttagtaacttgagaaagttattctgtttatgtttctgatagtctttatctaaaatggtatagactttgacagttttgttctcaattgatatgattatatcatttgccttcctaagcctatttatattgtggattacattgattaattttggaatatcgaacaaaccttgcgttagtgcaattaaccctaattagactaatataattatatttaaatagaaaatattttttaatgattttttttgtctatattggtaattggcccgtagtttttttctttgtttttattttgtgcttgttggtttttatattggggtaataccaatttcaaatagcaaattgggaaatgcttccttctcatattttgtggaagaaattttgtagaattgatgttaattcttatttaaatatttagcagaattcaccagtgaaacaatcaggacctaaagatttcttttcaacagatttttaacaggaattcaatttcctttagagttttaaggctactcaaattatctattgcatatttgataaatttagtaattagtgtcatttgaagaatttgtccatgttatctacattatcaaatttatgtgtgtagagttgtccttttggtatttgcagggtctatagtgacatctactttttctttcctgatacaagtaaattgtgccttctctctttttctttgttagttttgccagaagtgtgaaaactgtggtgatttttttcaaatagccagccattaacatttacttttcttgattttctgctttaaatgtccatgatttctgatcttaggttactgatttgagactttccctttcttaatgaaagcatttatttttatagtattcccttgtagaaattatttagatatgttccatcaattttgatatattcattttgatttagttcattgtatttttgaattttacttaggactttctctttgacccttagattatgtagaactatgtatttagtctgttgggaacaggatacccaaaatctggccataaattggcccctaaactggccataaacaaaatctctgcagcactgtgacctgttcatgtgaccatgacacccacgctagaaggttttgggtttaccggaatgagagcaaggaacacctggcccacccagggcagaaaaccgcttaaaggcattcttaaactgcaaaccatagcatgagtgatctgtgccttaaggacatcctcctgctgcaggtaactagccaaacccatccctttattttggcccatctttttgtttcccttaaggaatacttttagttaatctatcatctgtagaaacaatgcttatcactggcttgctgttaataaacacgtggataaatctctgttcgaggctctcagctctgaaggctgtgagacccctgattttcccactccacacctctatgtttctgtgtgtgtgtctttaattcctctagtgccgctggtttagggtctccccgactgagctggtctcagcatagtctttggaaatttttgaattattttactgttactgatttctagtattgttccactgtgatcacaggtcacagaatacactgtgtatgatatgacttactatgaattttttgaggtttgttttatggctcagagtgtgagatacggtctacttcaatatatgttccatgcacatgtaaaatgaaaaataaaaatcacagtacttcaattctgtatatcaagatctgatgttttatggctgtcactaatataggttaattgggaatttggggagacagtagtcatggtagtagtctggttgtgcgtgtgttttgcatgtgtttggataatctgtttcttttattgacttgcgttttttctttctttaaaacattttgtatctctttttctactctttcttgttcattcattctctttttccacgttactatttttttatcttgtcaattttttttttcttttactcatattcatagagtttaaatgaaaaaaggagaccaggatacagagagtaattgaagaaacatgacttgtccaaaggaatgaaattgagactatctagtccatttcctcctttaaattgaaatgttatttctgtgccaggacaagccttttttgagtaagtggatgctcaaatcaaccaaaggacacaagactaccacaaaacaggaagctacagcagagtataaattcagttcaacatctgtgtttccagatacatttagcttcagcaataacacatgcctgaccatggagaccacatgagtttttttaagaaccctgaaaaataagcttttgcctgttttctttggccttcagactggaaaaatgagcatattaaataggaacccagcattaaatagttttgcatctagtcaggtgactcagtgtatcacatttagagtttcttccacttttgtattttaaatattacataaaatattttctaataataacttctttaaatacagtaaaaacttaaaatctattttactttcatattcttttatccaactttcttcagagatataatcactcttattggtttagcatttcactcttaccagttctagtattttctaattctatttatgtgttattttggataatcatatttctctcacttactgaatgatgataagtgggaggaagtgaattccattgttagtgtgaaattattatctccaagggtgttgttaatttattgaaaatattatttgtcaagtgcctattgtgctagtccaggcattgtgctagtcactggggatataaaaatgtgcaggtacataaataactttatgaacaattaagggatacaagaaaagaaaaaaatgaaaaagttgtgtgctgagtattagtatactgtaaatacagagggcagataacacagacttgtggttaaagtagtattctcatggaagatgttgttaaagctaacacataaagaaacctaagaattattcacatttggggtatttgaagaagattcagcagaaaaaaaatgacctagaggcaacaataaacatgatactctttctgaaagtgaatgtttttcattgtgattttattttgcatagggcatggaaagggaagattgacagaaatgaggctggaagcagccataacattctaaagagtcaggtcagtcatatgcagaattgtggatactgtaaagagagcagtgagagacaataagacagttttaagttgaggagcaatataatctgaagttttaaaagtgcgcactgttggcaatgtgaagaattgattagagaagattaatactgcagacaggtagaagatcaggtaagagcactgttgtgataatccaagaaagcaattatgagggactgaattatggtttttgcaaaatgtaggaaatgagtgaagatgactttcaaagatttccatatgtgggtattaaaattaccataattataggaatgaatacatatgagagtgataaaaatgaattgcaagcttctgacttaaatcgcttgaatgagtaaaaatgagttcataagaaagagggcagcctgttgaataaggtattgagttcaattttcagtatggtagtttgagggggaatatttaattagataaactactacagctatctgataggttcctggagaatcaggtgtgaatttaggcaaaaggtctaggtgggattttatcacaagctaatgtataggaatggtcaagaatgcagaaaagaagtcagaggaaaaagataagaactgtataaacagaaaatacattctgaggaacagtgaaagcagtattattaatgttatacagtttccagagtaagactagataaaacaatatggaagaaaaagactaccactttaaaaccaaatcataaaaaagaaataaaaatgtccccaaaaagtaaatgtcaaaatgaatataaatccggactttaaatagaaatcatttaaataactaattttagcagtgtaataatatactttaaaatataaataaataagttcaattgttatcattggcataatgttgtaaactaaatgtcttttaagactgggtaatgatctcgtgagagttcttataaaaatagccaatgacccattctttgtgtattacctgtgtgtgtgtttatgatttactgtttaattatttgaaattgtcagcttccaatatgtattaatattaaaaggtacagttcaacttgtatatatgggctgagcatgtttcttacaaaaaataaatttttgttatgggtataaatgattgttataatatcaatgcctgtggttcaggaatacagatttcctcttttataaatgtatgtacaaaacatcacttcagaagttattaagttaataacataatcatgggccatgataattatcttatgatggtcatcatttttaataatttaaagaaaataaatacataaataacagaatatagactttctgatattgtgtaaattgaacattcttaaaattaacttaagatattcaaataagaaactgaacctagtaacatcaatttttaaatttaatttttatacttagggagggagacttctaaccggaataaaattataataaggatgtgttattcaaatctcttcaaatgctcccacgtaaacatatattgaaaataggcaagcagcaacaacaaaacaatagaatacagaccaccctcaaaatttttaaaaaatacactgtaaaagataatcttacaaagtttagaatatgagtggttttagctatgtagtcaccaaagtaggttcacattgacttcatcttctctgttgaaaataagagagaagtgaagagagctaagatgattatattataataacctaacaagtcactaaaaacactcacctacacaactgaggttctgcattctgaatggaatactagacatacacataaaagcatgaatgaaagacagcaaacattagatatgagaaaaccaaaaaggaggaggatttggaaactgaattgttagagcttagataatattttgaaattaatggaaaaaacttgtttcagaactgacaaccaacttacaaaaaacgaactaatatcatcgtgaaatgaataataagaaaaatcgagactaaagagagaatataaagagggaaaatgaaaacaaacaatcaaatcaaagtttaataaaataaaaaagatccaaaacttacatagaatatgagcaagatataaaaatgtatgtttaatcggaatttaaataaagaaaaccaaataaagcagaatgaactctgaaatatacagttctagaaaacttccttaaagaacacaaacataaatactgaaattgcacagtggtgaattagaaaaactaatcaagaatagaagtcactgatatataatccagtaaaattactcaaaatttaaacaaaaaaggaagaaaaaagaggaggcattcaggcaaaaatgtagtatttaaaagaaaataaaaagcaaaaagcagattaacatcagacatatagacaattgatatctgcagacaatgaagcaaacatactaaagaaaatacagggagacacagattaatatctagtcaaacagaattacaggaataaagttcacagacaaataattttaaacatgcagcaattaagggtgtactatttccatgagcacttctgggaagtctaagtaatgagctcatgtgcacaggaaatgataggagaagctttgacataatgtctaggggtggataaggatacatttaaatagaaatgttaatgatgggaataaaaaagtcaatatagtatacagatgatgtgtagtctaaaataaaaattagaaggatttaaaaacgaggaaagaaaaataaggttatataaaattataataagtttgctaacagcttcctgcatgtaaagagaaataaacacagatatcactctttaatatgtgggaaacgaggatgggtagcagatgtttcaggttatctttatagaaagaaaaaaatggtatcacaaaagaggaaactactttcctaaatataacaaagaagaagaaaactaacgaaataataccttgatcacttgaatacatatatatgtgctctctctctctctatatatatacacatatacctcatatacatacacataagcataaaaccatatcacctcattgattccaaatataactttcatataaataaatttaaaagcttaacttactagcttataatattttaggttgatcaatgaagtgaaatctattctgtataatagtggtacatctgaaactacaactagaaaggttacaaaaacgacgtacaaggttacaacaggagaatgcaaatggggtcaatattttcatataccaaacaaggtataatcaagccaaagaacctatgaaaatgaagactattttataaggcaaaaggtgactttcataagaaacatttaacagttattaataattatgcactaaataactcaccgattttcataaagcaaaaatttgagtagattcaagaagacagacaaatgttaaattatataaagcttcctatctctctcagtccaagtcatatacaatcataatatttagtcagtatgtatatagaacttacaaagaaaagttaatgaaactgttcttatatatcaaactccagatctaacaatagaaaatagacctgttctcaaatgcataggaaatattctcaaaaatttaacaaatattcaattataaagaaaatcttttttgcaaatactgtatttatgaaaatagaattctctgactatatggcaataaactattttgattaaaatatctaaatgcttgtacttggaatacaaaaattattatacctggaacgtcaaagaaaaatacaagtttgaaacaaagcaaagcaaaaccaaacaaaaaatccaactattagttacattttagtcaaaggagaaataaaaatattttatgacttttagaaaataaccattatttgagaatgacattacatattgatatgagtaggttaaagcaatgtctcaacaaaattcataatgataattagtaataactagaataagtgcataaaaatacagcatatattaaatgtggcattccaaattttttaggaaaacaactctatttaaaaccagtgctggggcaaatggcgtacaatatggaaaaaacaagttagaactgtctgtacaccaaatatcacaataaatttcaaaggaaaaggaaacctaaaagaaaaaaaaaagaaaaactaaatcaaagttctgtaactacttacagaagcctttaagataattttaaaatctgaaagttaatttaaattcaagcagttataaacgccctttcaagatatattggaaatccaaacattcattccgtttgtggtgatagacaggattggcaatttgaaaccctcaggagacagaactgaccagaattgatgaacaatttgataacaggattagagaaaagtaattctgggttttaaacaatttgctaaaagtacatactatagctccttctttcttcccctgaccctcctctcccttcaaataagatacatattatactattttaacaaaaacattataatggaaataaatgtaaaatgatgagagagagttaaagggagtgctgggcaagttgagtttggtaggattgtagtactactcaaatggattcagatatagatacacaagtggcatttagctatatggagatgaaagtttaggttgtaagagcaaaattaaataccaagagtgatggtgtagacttaacagagaatgaggttttattacctgtcgtttcccaggactgttgtaacaaattgccaaaacatggtagcttctaacaacaaaaatttattctctcacacttctggaagctggaagtctaacatcaaggcattggcaggttggttcctctgcaggctctaaaaggcaaggttcctcgactctttcctagcttctggttgctgctggcattccttggtgttccttggcttgtagctgagtaactaatctctgccactgtcctcacatgatcttccactctgtctcactcttctgtatgtatatgtctcaaacatcccactgtgttctcatataaggatctcattttgaatttagaggccatcaatccaagatgatcttatctgaagaagagtatctgcaaagatcctattttcaaataagattacattcacaggtaccaggtgttaggagttaggcatatctttttttcggaaggaatgccattcaacacataataaatgactacgaaatattttgtcaccattttatacagcagatattaaaagaaagagaagctagaaattcagattgagtgatacggtttacaatcatagccagttctatgtagtccaaaaagaattttttttttcagaaggggggctgagaacaggactgagcagacacacagcatcatgccaggcaatgcaattaaaatatgtgttataaaatgagctttgtcctcaaaagtcttcagacagagtcaacatcattttcaatatggttcaagtcaaaaataatcttaaagagtcttttatcacaatgttattttaattggtgattagcctttgttacattgttgttgttgttgttgttgtgacaaagtctggctcagtcatccaggctggagtagaaggggcatgatctcagctcactgcaacctccgtctcccgggttcaagcaattctcctgcctcagcctccctagtagctgggactacaggtgcctgccaccatgcctggctaatttttgtatttttagtagagatgggattttcgccatgtaggccagcctggtcttgaactcctgacctcaaatgatctgcctgcctcagcctcccaaagtgttggaattacaggcgtgagccaccacgctaggcctagcctttgtaactttagcattatgtttacttctatattgtgataattaccaaagtaaaactactataagcaattttgtaaacatgagttatatgcattattcttctgaagccaaaagaaaaaactaattcatttttagtaaataaaaagattagcttttaaaagtgaaaacattggcttttctttacgaattctgttcattacttctggaagagtctgctttaatgggtcaatcttgttatgcccactaatcttggggaaggaaaagaaaactctttattttaagaccaaatacccagttgatactgggatgggaattaagaaattccctggagatcattgatggtcggatgggattgaggtcagtgagttgctccctgacacgtggaggtatggtattaagcacaggaagactgagaaaaggcttttagtttttatttggtgtatagtttgcaagaatgactacatttttcttttcttttcttttttttttttcggatggggtctcgttctgttgcccagactagagtgcaatggcgcaatcctagctcactgcaacctcggtctcccaagttccagcgattctcctgcctcagccttccaagtagctgggattacaggcatgcaccaccatgcttgagtatttttctttttctttttctttttttttgtatttttagcagagatggggtttcaccaagttggccagactgttctggaacttctgacctcaagtgatccgcccacctcgccatcccaaagtgctaggattacaggcgtgagccactgagcctggccaacaatgactacttttagtaactgcaatttatcccaccccaaacttgtagaaaatagcaaagaaaagtcaatgttccattcctaaggccatggtggaacaatcagccactgactccaggaacagcattaagcctcccaaagaaggcagcaaaaacatgatggaaactgtgcctgagactacaacagatgaattacaggagagacgaagtcgatatctcactgtcagggctatgtgtaaccagagagctttgggtaatgtgaaggctttatccagtcatttccaaaaagaacaagaatgaaaaatacagtggaagtcttaggttccccgaattacacataatggacaattttattacaagcatattggattaaaaaaatcatatcataaatattcagaccgacaaaacgtaagacatgtagctaatatttatttttaattgtcagaatttcaaatttttaatgtatacctgtgagggataatcatatatttagcttcttgaaatggattggaatttatatttttcataaatgtaaaggtatctctcttttttcctgaaactaagattgctaaaggcagaggtaaatattgccttaaacaatgataagaaagacattaggcaaaatagctaattattgactaaattcatccttccttttctctaaattaactgatattgccttgcattttaagttattttttctgagtaaagaaaatatgacacctgtctttgtctttcatatacatttttattcattttttctctttgtgtcaaatacatttttaaaagaaagaagctgagataattagatgcatcagccttacagaattttaaaagaaatcctctcataaattgttttcagtggctagagtatttagtgctccaataaaattagaagatgatgcccatttcaaaatttgatataacatatcaatgcaaggtaataagatgtttataaggaaaactattagaacacctaaaaggagatttcattgcagtgggcttaatttctagaaaataaatcgtctctcagattttcatgataattacacacgtaaataaatacccaaatgtgtcagataactacaatatacaataagcttattaaacttgtttttaaagcagatttatttattttgaacgtgaaataaaatattttgagttacataaataattcatggtgacattgagaaaaagatggtttctatattgcacactgtctctgatttccagctgtcattcttcattagatcgtgttgaatctatcatcaagctgcagcagtcaagacccaattgctcaaaaaagcctttggcatgagattccacagaacatggaaggtagaagttaatataccttagtatggaaacagataattttattatagttgttattattatatgttgtcaagtagagaaattacagggaagcaaatgatataaatgccttatgagtaataaattgtgagggggacagtatggcagataagaatgaattaaccttgtttcactacttgtaagatatatacgattttattttttccaataaaaatagttcaacattatgcttataaatgcacgttttagttttcttggtcaagaaagtacaaacctaggttttttcttttacattatgtaagttttaataagacattgtcataggcacagttaaactataaattaaatttaactcaatgaataagaattctgtaacatattcacttagtcaaagcaaataactaatatgacacactgcattacaaaatttattaataatggggctggtggtaaaacactagaacatccttgaatttatttcaaaataaaaagggaacttctagagtgaatgaagaattcaacgacttgtctaacacacactttttttttacttgccataagaatattttattttatttttcatcaacttttattttaagttccagggtacatgtgcaggatgtgcaggtttgttacataggtaaacagcacacactttttaatacctaagtgcctacactgtaactagtaaactgataaataagacactttcattgtttccattcaataaaccggcagaaagaaaaataattataacaatattacaaactctatggtaaagctatagtttatatgcagttagaaagaacgaaaataattatttttgttaatgagaaaagacttgaaagaaacagtgacatttaaacttggtattgagatgaaggcacaaaagtagactgagaataaattatgaagatttttaaaatatactatgaaaacttgggagtcaaataaactctttaaacgaataggtgacataagctgatttgctttccatagtaatcaatctggtctcagttataggtgatgcatgtgcacagacagaaactgggaacaaggcttttgcataagttcagacaatagaagattagaagctcaacaaaaatggtagagattgaaatgcagaggagagaaagattcaacagtgataagtaatgttagaggcagaatctgtacaatttagtgaaaaataaaatataagtatttcaaagaatagataaataaaataacaaatataggatgaatatacatataaatggaaacaaataacttttaggtgtattttttggggctttcatctacagagatccaacagaaagttttttttaaaaaatgcactggcttatttcacttagcatagcatcctcaagattcatgcgtgttgttgcatgtgacaggttttcttcttttatgactgactagtatactgttatatgcatatactaaattttctatgagatatctaaagtaatcaagctcacagaagcagaaaggaggacagtggttgccagggactgggaggagagggaaatagggatttgctcttcaatgggtataaaatttcagtcacgcaagataaaatagttctagggatatgttgtaaaactgtgcttatagctaacagtatggtactgtaaccttaaaattttgctaaatgggtagatctcacgttatatgttttgttaaccataataaaaaatacactgtatggtggaacaatacagtcactgtggtttgtgggtttgtttgttacaacatggaatttaataatatataacacaggaaataaatactctcattatcctacttctaagatatattaatcaatgtcttaacataatcaatatttatttctcactcacccaaaacttgatgtaggctatgtagtccttgtctatcttttaacttctcaatctggaacatagggtctccaaggtcattactggaagtttgtattagaatttttaagaggaccagtagtggaaatgtctttcactgctttcatcccacatcttgtgtagggcccaagtacatggaaactgcaagaaaggctgagaaataacttcttgtgggtctaggaagagaaagtgataaactaagtatatagtaacacatctgtcacatcacaaataattactaatagtaatctactgtatttaattctagtcacaattatttaaagactttctacataaaactacgtgtaaatggaattgtgttattttgtttttcatttgtactgcgtaaaactctatcatggtaatttttgtgtacaatagcccccattatccacggcttctgttgcccctggtcaaccacggttagtaatattaaatggaaaatcccagaagtaaacaactcatgatttattcatttatttatttgtttattttgagacagagtctcactgtgacactcaggctggagtgcagtggcgcaatctcggctcactgcaacttccgcttcccgggttcaagcgattctttgcttccagagtagttgggattacaggtgtgagccaccatgccaggataatttttgtatttttaatagagacggggcttcaccatattggccaggctggtctcgaactcctgacctcaagtgatccacccgcctcggcctcccaacatactgggattacaggcgtgacccactgtgcccagccaacagttcataagttttaaattgcccgctgttcatcagaaagctcactgtctggctcccgccccttagtcacttagtgaatcattcttttgcccagcatatccacgctgtccatgctacctgcccacgagtcactcagcagtcctcttggtgatcagattgacagattaagagaagaatggtgaagacagtacaataaaatattttgagagagaaagagactagattcatgtagctctcattgctgtatattgttataattattctatcttatcattagttatggttaatttcttactgtgcctaatttacaaattaaactttttcagatatgcattatatgaagaaacatagtatatgtagtatacattaaatttggtattatttttggtttcaggcagccactggggggtcttgaaatgtgtcccccatggctaagcaggggctaccataaacaattttattgatatacttcatttttaaatgacaacagttatctctttcaatgtaattcgtttacctaatgtttgaaatgcggaaaagataagaatctaggaagacccttagatttgtattttgagtaatcaagtagagagttttgttatatattaaaatgggaaaggatagattgaaagaaatcgtgaactctgttttgaacttgtgatgttaagatgcctattagaatgaaaatattaagtggacagtccaggatttccatctggaattcagccagtattttttattcaaattgactgatctagattccacaaatttgaaataccaccatacaaatgatgaaatttctacatatatgtataggttggttctgctttctattttgttctattaagtcttttttttctagccctgttcatattctgataattttattattacaatttttgggcattctttattttatgatggtaccttgcattttgttattttctttagagtgacgtatttaatcataaaatgattttcagaactaattcctcaacctgttccccttccaaataatacatgcagcatctttgagactatattgcctaataaaaatcctttatatgaatataaaaatcaaacagaagtccatttttaacctaagctcagttgaatgggcttctcctctttaaaaataaatgtcccctaaggcactgagttctaaataaagttgatgttaaaagagtagtacagaaaactttttcaaatacaactttcatgtgaatataacaaaaactttcacttgaataaaataaaagaaaaacactgaaaaataaacacagctggtaaaaataactgaaatacttaaaaaacattgtattttaaatcgtaacatttcatctttctaagccaatagtgtcatttaatgaagtgttagttatgattctgtagtgtacgttatttattgcttactaagcatccactttcccatcctatgtccttacagaatttcaaaattcattcagatttgcattcttcttcactctgttgtgtgtttcacagaagaagcccacaaccccataagtatgctattctctttgcctgtgcctgttttgccatgagcatgtggcacagttatgaacaaacacacgttagaagaagttgtttacagggttcagataagactatataaacacaacatttcttcttcctttggagatttttaaaaaattgaattgatgcctcgatgtgtctgaaactcctagaactattatggtaactctggcatacagaaaatgacaacatacaaaacatacacctgaggttttgatgatattttaaaatcagaaataacttataatggtaaggacctacctcccaacatctaaataatatgaggaaattttgttctctattttcttttatttgcagctgaaattgttctctttgtttgtttggctgagcacaggggactttattgatggtacatgacaaggtgaggctccctaggcccctccctcttcaaagggtctgcatggaaactgtgaggaggggagattctcagtgtggtgggggactgaatgtggcagggactccccagcagctgagggcctctttttgtatcttgtgctctccctggggctggtggtctgggggtcttactctttggaggtcaagtggaccatgaggtctatcaccctgttgctgttgccaaattcattgtcataccaggaaataagcttgacaaagtggttgttgagggcaatgtcattgccctcattgacattgaaagcagaagagtgggtgttgctgttgaattcggaggagacaacctggtgctcagtgtagcccaggatgcccttgagcgggccctccgatgcctgccccaccaccttctcgatgccatcatatttggcagtttttcccaaacagcaggtcaggtccacgactgacagtttggcggtagagacacagaaggccatgccagtgagcttcccattcagctcagggtgaccttgcccctgttcttgacagtgccagtagatgcagggatgatgttctttagagctccacggccttcatgccacagtttcctggaaaggccatccacagtcttttgggtggcagtgactacatgaaatgtggtcatgagtccctccacaatgacagttgtcatggatgaccttggccaggggtgctaagcagttggtggtgcaggaggtattgctgacaatcttgaggctgttgtcatacttctcatagttcacgcccatcacaaacacggggtcatcactagaggcggcagagatgatgacctttttggctccccctgcaaatgagccccagccttctccatggcggtgaagacactggcggactccacaacacatttagtgccaacatcaccccattggattttggtaggatcttggtcctggaagatgatgatgggatttccattgaagacgagctttccattctcagccttgactgtaccatggaatttgccatgggtggaatcatactagatcatgtagactatgttgttgaggtcaatgaaggggtcattgatggtgacaatatccactttaccagaattaaaagcagccctagtgaccgggtgcccaatatagtccaatccgttggctctggccttcaccttcaccatggtgtctcagggaagaggctggtggtgcatgagaagatgcagctgtctgtcgaaccagaagagcagagagactgaaattgttcttaatgattacaagtacaaaccgaaatgccttaaatgattttaaaagctttcttgaattattaacagttcatttcacctagggggcagtgatgagctggggaaaaaaatgaccacattggtacagtatactgaagtgcaggttgccactctcactcttgcaaataattttaattgctctcctaaattgtctgtcttggaaaaaaattttgagttgaataaatttccaaatattcatgtttctctagcaactcaccaacagcaattccaaattggttgattatatgttgacattcattaaaatattagaagaaaattaaacatttaaaatttggtaatttgatattttttacacctgatgtggtgttggccttcaatttttcacaactgcttaaactaactgcagttgattctcattattcacagagtccatatttgtaaattcccctatgagctaaagcttatttgtaatcctgaaattaatacttgaggtgcttttgccatcatttgcgaacattcacagagcagcaaaaaatttgatttgcctgatatacaacacctaaggtagaacaaggtaactttctgtcttcttgtttcaattctcatatcctaatcagtgacatttctgagctctctttgtgcagtgttctttgcactatttggttttcactagtgactttacaccttcaaatgcttctccccctcagcctagtgctgaattgctttctagtactcctgagtgcaagaagactgtgatctgctacatggagaaatcaggtgtattagatgatctctgttcaagcacaaatgatagtgtattggctgtgagttcaatgttaatgaatcaacaataattattaaataaggtgtctttagactgaagcactcataaaacaatgttatgtgttgattggttgatgaaaatgtgtagccagagtgcacaggacactaaccctgtattttccataggggcttagtattctctaagtcagtgtttttggtgaatttatagaacataactactatgaatagtgaaattcacctgcatgtgtgtatatattattttgcataatatttatatactgtgtatatattatattttacatctatataaatcaatatatataaatttatccttttaataaattaagttacattttggacaaatattgatgttagtttctagtaaagttttccatcttacatagcttttttctatttttcatttggagttttgattaaactactataattctatggtgtttctattctaatttattactgtaccgatttacatataaagatattctgaaattataacacatttgaattcttagagtaaacaatacttggaaatacacagaatacattttacatagatattcatcaaaatatagacggcaagcagaaatatatgcagattattacaccactatattaattaattacaattttctttacaaaaaacacaaaatcaatattcagatgaataagcaatattagtgagacaaccaaaagcctctgacatgccccttcccagacactactctacacccaaagtagctgcaatattgtcatttaagaccacagcttgtgtttacatttatataaataaaatcacagggtataaacataaacttctaatgcattttttgttgagaattatgttctggagattcatgcatatagttgcatatattttgtgttttttaaattgtagctcatcaggaaattcttgaatcttctctatcagatacataagggaaagttacccaattatccatttcattctcttgtgtaacattaaatcaaatttaatgagaatgaatcttagtctacggattcagttgagcaagaacagcagcattaacaagtaaaattttatttaactcaagttctaaattagtgctctcattcttccttgtcctgttttattgcattatcctaagataattcagcacattactaatgaggaaaggctacatctgagctttagtcacagatcaacaaaggttgtggctcgaatgcccattatccctgttctatcttactcctgtgctcataaccacttatagtttgaaaataacctgctagttctgtgtcatgattagggcacaggaggagttttctctgacactacctataatcctccatgttcaattgtgttacataggaatttcccttctgacctcatcaatctctcacagtgatgctaagcacaacatacgctacctttatattaaagacctttagaatatttcctcttatttttctcttcttaaccagtcagactaatatcctttcaatttcatgatcattttttgcccttcatgtgttttcaagatattgtgctcttatatccccttcattttatcactctgcacacattttgaggtccttttgaacttagacattttgctgggaaaagccagcaagacatgaaggcaacttcattttgctctcccacatgcttcctcttagataacgaattagagaacaatctatgaatttaaatgtgtggataaaataagtaattaaatattgttaataagcatacatattttaaatcttgaattttttcttattagcccactaaattttactgaagatacagaaataggataaagacaaaaattaattgtgagaaaaaagcatacaaacttaccaatgctttaaatccaggtgtggagacaaccttttgatagcttctggtgaacttcctgagaaacgatgtttcatctggggtaaagagactggactgaagagatgtgaaggtagtttctcactccaaactctgattattccaaatattaaatattattgcaccatctgaattatcaaagctctccaaatccaaaacattctagtagattcaattgcttcttctgagagtatatgtattggttttataaaaggttaagaggaaaaaaagaatcagagtagatttaagctaatgctgtcatgtagaatagaatgctgaggttcaaaaagggtgaatgacaaaactgagtctaaaatattagcatcaacggtatggctttttatatattgacttccgttttgctccaaggcaaagcattttgaaattatattaattgtgtgtaagttaacctttgaagaatgtattcttaattctatatgtattttttaaatcatgttatattatctgaagttgaaaaacttattctcaaatagttgaaacttatttcttgcaggtagaaatccattcatttaattaataaaatattgaataattactaatagttaataagctaaaaatataagtggctattattataaatatatcagtttaatactataaccctaaataatttatctcctgaaattctaaaaagatttttagaaacaaaaagagtatcatatcttaacttctttatatctgttatcacatttcctaggaaaccacattataaatatgcaattttaaaactaacttcccttaagatacatatgtaaatgatatggttgctaatcaaatcagacttcatccattatttcttgttgcataacaatttaaagcataattttgttttatatatcaacaacattttcattctgggaaatagcttcataatatatactaagaccatataaaatgaattattattgcaactaagcgtgtactgtgaaatggcttagcaaaacactagcttgcatatcatattcttgtcctgcttaacaactgcaataaaatagaaatgataaggccataaagaacagtgtagaattagaaacagtaatcactgtgcattacattaccatttgatatgatgaactgtagcttgctgagagtaatcttaatgaggattacagtagatatattaaaatatatatgtggccttctattaacaataagacactcaaatgtatttttttgcatctatatttccatgctacattgtaaaggctgttattttaattaacaggactttgaaaatccatttgattagaaatttgaatgccaagttaaaccatcaataaaattaatcagaaacaacatactgagcaaatgcagaaaatttcaatggttttcaatttttattgtgaaggcaaattaaatttaactgaaaagatgtatcatcatgtactgacattcagaaaactatccaagacttagccattggctcaccagctggataacttgcttttatgagcatctattctcacaagatgagcaggacatgcagttgtgtttaaaaactcaagcaatcatataattagtgctatatattttctgccttgctatcaaagaatctaaatgtatcgtattatttaggactctttcagttaaatatgtcagagatcctaatctaactagggctaaagtttgaaggaaagggattgggtttttgaaggaaaggggttgagtttctcttattctgtagactgcttattgataatttattttgctgtgcagaagttctttagtttagtaaggtccctgtgttagttggctttgtgtcactataaagaaatacttaagggtggataatttataaagaaaagaggattaactggctcatgattttacaagctatacaagaagaagcatggttccagaatctgctcagcttctgctgagggctcaggaagctttcagtcatggtgaaaagtgaagaaggggcaggattgtcacatcgtgagagtgaaaggaagagagagaaggaagagatgttatacattttaaaacaaccagatcatgcatgaactaacagaacaagaattcactcatcatcaaggggatagtgctaagcctctcaggaggcatccacgcccatgacaatacctgccactaggctccaccttaaacattggggattatatttcaacatgaaattttgaggagacaaacatcccaacaatattagttccacttgttaatatttgtctctattggaattgcttttggggatgcagccccccaattttttgcgtacaaggatgtgaagaagggtattgcctaggttttcttctaggattcttattgtttgaggtcttacatttaaatctttaatccatcctgagttaatttctgtatatggtgaaaggtaggagtccagtatcattcttcagcttgtggctatccaggtattccagcaacattgattgaatagggggtcctttctccatttcttgcttttctcagctttgttaaatagcagatggttgcagatttgtagctttatttctaggttctccattatgttctattggtctatgtgtctgtttttgtaccagtaccaagctgtattggttagtgtagccttatagcatagcttgaagtcaggtagtgtgatacttctctggctttgttctcttgggttaggattccttcagctatctgggttctcttttggtttatatgaattttggaatagatttttctaattctgtgaaaaatgtcatggtagttcgataggaatagcatggaatctgtaaattagtttaggcagtatagccattttaacaacattgatttctttaatccatgagtatgaaatgcttttccctttatttttgtcatctctgacttctttgagcattgatttgtaattctctgtgtagaaatctttcacctattgggctatctgtattcctaggtatttatttttttatttatgattattataaattggattgtgtacttgatttggctctcagattgaacattactggtatagaaatattactaatttttgtacatacattttgtatcctggaaatttactgaagtcatctaccagttctagaagccttttggtagagtctttagggttttctaggtatagaatcatatcgtcagtgaagagagataggttgacatattcttttcatttttggatgccttttctttcttcctcttgtctgattgctctggcttggatttccaggactatgttgataggagtggttggaattgatatccttaccttgttctgattctcaagagaatgcttccagctttcactcattcagtatgatactggctatgggtttgtcacagacagctcttatcattttgaggttatgatagctcttattattttgaggtatgcccctttgatgcctagtttcttgagggttttgtcataaatgtatattaaattgtattgaaagatttttctgcatccattgagatgaccatatatttgttttcaattgtttatgtggtgaatcacatttattgatttgtgtatgttgaacctgccttgcatttcatgaataaagcccacttgattgtggtttattatctttttgatgtggtgttggattaagtttgatagtattttgttgaggatttttgatcctgtgttcacaagggatattggtctgaagttttagtgttctgttatgttgtagccagattttggtatcaggctgattttggcttcatagagtcaggggggagcctccctcttcaattttctgaagttttttcagtaggagtagtatctaggtatctagataggttgctgggtaaaatggtacaactatttttagttctttgagaaatatccatactgttttccatacagacaatactaatttagattcccaccaacagtgtataggcattccttgttcctcatagcctcactagcatctgctattttctaactttttatagaatagccattgtgactggtgtaatactgtatcacactgtggttttcatttgcatttctgtgatgatgagtgatgtggagcattttttcatatgtttgttggtcacttgtatgtcttattttgagaaatgtgtatttatggcgtttggccactttttaataggtttatttgattttcttttctggagttgtttgaatttatcctagattctggatatttgtactttctcagatgcatggtttgcaagtattctctttcattctggagattgtctatttactatgttaattatttcttttgatgggcagatgttgtctagtttaattagatgtgcagaaactttttgatttcattaagtccaatttgtctatttttatttttgttgcatttgcttttgcgatcttagtcaaaaagttgttgcctaggccaatgtcctgaagagtgttttctaggtttcctttggggatttttatagtttcaggtcttacatttaagcctttaatccactgtgagttaattctgcatatggtaagaattagagatccagtttaattctgccacacatggctattcagttttcccagcaccgtttactacatatggtatcctttcccactgtacattttttttttttttgacgaaagtcagttggttgtaggtatgtggctttatttctggattctctattctgttacattgatctatgtgtctatgctcatatcagtacaatgctgttttggttacaatagccttgtaatataatttaaagttagctaacgtgatgcatccagctttgttctttttgcttatgatttctctggctctttacgttcttttttggttccatatgaattttaggatttttttttctaattctatgaacaatagcattggtaatttgataggaattgccttgaatctgtaaattgctttaagcagtatggtcattttaataatatatccttttaaaaagtgagcgtgggatgtttttttcatttgtgtcatctacaatttcagcagtgttttgtggtacacattgaagagctctttcatttccttggttaaatgtattcctatgcattttattttattttgtggctattataaataggattgagtttttttattatactctagttctaggatacatgtgcagaatgtgcaggtttgttacataagcatacacatgccgtggtggtttgctacacccatcaaccagccatctacattaggtatttctcctaatgctatccctcccttagtccccccacccctgacaggctctggtgtgtgatgttcccttcctcgtgtccatgtgttctcattgttaaactcccacttatgagtgagaacatgcggtgtttggttttctgttgctgtgttagtttgctgagaatgatgtttctagcttcatccatgtccctgcaaaggtcatgaactcatccttttttatggctgcacagtattccctggtgtatatatgccacattttctttatccagtctatcattgatgggcatttgggttggttccaagtatttgctattgtgaacagtgctgcaataaacatacgtgtacatgtgtctttatagtggaatgatttataatcctttgggtatatacctagtaatgggattgctgggtcaaatggtatttctggttctagatccctaaggaatcaccacactggtttccacaatggttgaactaatttacactcccaccaacagtgtaacagcatttccatagttaggggtgagttcttgattttgttctcagctttaatgatcttgttttatgaaaatgctactgatttttatatgttgattttgtaccctgaagtcatcattttcaagtttaggagtcttttggaggagtgcttagggttttctaggtataagattatgtcatctgtagaaagagataaccttatgtcatcttttccaactttgatgccttttgtttctttctcttgactgttcgcaatggctaggacttccaataccacatcgaataggagtagtgaaaatgggtattttgtcttgttctagttctgggaaatgcttcaacttttccccatttagtgtgatgtttgttgtggctgcttttgctgtatcccaggtgttttggtatgttgtgcctgtagtgtaactcattaacttttttttatttctgccttaatattgtcatttactcaaagatcattcagcagcaagttgcttagttttcataaataaataaatttgaatagcttttttttttaaacaaatcctcacgctgtcatccaggctgtaatgcagtggcatgatcttagctcactgcagcctcaatcttctgtgctcaagtgatcctctggcctcagcttcgcaagtagttgggactacagtcatgtgccaccatgcccagctaactgtttttaaattttcttgtacaaaaaagtacaaaatgatggggtcttgctagtctaaaactcctggccacaagtgatcctctcagctcagcctcccaaagaactgtgattataggcatgagtcaccatgctcagccacatttgtggagttttgagagtttttcttggtattgatttctaactttatatcactatggtccaaagagatacttaatacaatttcatatttttaaaatttattgaaacttgccttatggccaaacatagtatctatttgggagaatgttccatgcacagatgagaaaagtgtatattctaaagtttttgagtagaatgaatggtaaatgtctgttaggtacattttgtctagaatctagtataattccagtttctttgttgattttctgccttgttgatctgtctagtgctgttactagtgtgttgaagtcttttgctattattgcattgctgtttatctcttttcttaggtctagtagtatttgttttaagaatatgggtgctcctgtgttgcatgcatatatatttttaggatagtaatatcttgttgaattgaaattgtcattattgtatattgacttgcttgtctgaactcaacctccaggctaacagttggctctgatagccaagagctgcctgtggcacaatcagatgggtatgagcttgatctttctttaataagatgtgctctctggtgcttcaggtgatgggttggtctgtagaatgcccagtgacctgagttccctgttcagtccatggtcaggaggacaaagctgggcagagtcataccagtgagctttcccataaatgtcccaatgacaagtgtaggcaccagtcctcttaggggtggctgggggaaatcctggtgaaatatgctgaggtcacctcagaaggaggaaggcagcaccgattccactttttctaaaaacgtttttgtgtaaagcaatttctctttcctctgaaacacctatggaatttgaatatctctaatacctttagttacactgtagtccttaacatcatctccactaattctataatcttcataatcattcaggacttgaacaactgcctgtattacttatgatgtagctccctatataaggccttgaatattcaatacaagattgatgaatcaacgaaagcattaaccaactgaaacattgatatttgtaagatggtattattctttatatattcttactatgtggcattgtggttaacttttttttttttttttgagacggagtctcgctctgtcacccaggctggagggcagtggtacgatctcagctcactgcaagccttgcctcccaggttcacaccattctcctgccttggcctcctgagcagctgggactacagctgcctgccaccatgcctggctaattttttgtatttttagtagagacagggtttcaccgtgttcgccaggatggtctcaatctcctgacctcgtgatctgcctacctcggcctcccaaagtgctaggattacaggcatgagccacggcgcctggccttgtcattaacttttttaaatcaacattttattcttttaaaatatcacacgaaatttagaagtctgcttctctctgcaattagttcagtactttactttttaccttttagcctcttacctgacccatcaatcctgctgtaatcagatttaagtcttctctggctacagaacccaatatacactaaatgttaacatctcacaggtattcagctacttcagacaacatattaaaatgacaaaacacaatcacttttgtctacattctaaaattcacttgatataattgaattgtagaaataaaggtgaaaacacattcagtacatgttacatcaaagaaatgtagagaaatttaatgagtattggacagtactttcaaggaaaccttagtatgattcagagaaaatgtttactatttggacgtagtgacctaaacgaaatgctcgcttttttgatgcctgctctttatcctatgtcatgtcaccattgttatcagaacagcacttatttattgctcatccagaaaaagatacaattaacattgacaacttaaaatatatgtccttctattttgcacagtaaattttgcaaaatacgcattactccttttatgtcaatggtttctgaactcaaactagtaatctgtcattttaatgacatttgagctgtcaaaataataagcatttaatataaatattgaagctgctgctagaaccctaaaacaaaggattgctgtagcagaataattttcaaaactcagataatagatataataacatacacagaccaaaaaacaacatttggaatttttttcttggaaaacagggaggatgtataaacaggataaatccaaggttgatagtcataaagaaggctatgtaaacaattacttttattaaaatcgaggctttagatgttaaaggtgagaaataaagatgaaagtatcatataatttatgaccataatgcaatatcacataaaagctgtgtatgaaagataaaattattgtgtaaaaagaactaattaaaattttattttaccaagtttaaactgagataccaatttagtcttcactaatttactggttttttatttatttcactgcaaaaggggttaaaaatccctacattgctccttcatagaaagattgtacatgcccaactcaatatatagggaaatgtttttaggctgtataaaagcaagatactaatttttatttctcagatagcaaatatatatatatatatagctacaataattcagtagcaatttcaagaattaaaatttaagcatagctatctatagcttattttgcttattttctttcaagtagtcaggtaattttacaaatagcatatttttcctaataatttgcattaattgaaagaattttgaataacatttgtagtattgttacattctattgttgtctaacatatttctgatcatgtgaaatctaacatagaatatgcaaatcaattaaatctaaaatttctgtatttactgtgagtaaacaaaaaatatttctctgaaaatttttacagtgcttactgaatgagtactattttcattaaaataaaatcagttttctgctgctgtgtgtagcagagaaactggtaataggctagatctgctataaacaagtgagaaactggataaaccactttctgatattatacaagagacattgaatgatgggagccattgacgaaacagaaagttacatggtgagcccacggataatttcaacttttaaaggtttattttattgttaattaacacataataatggtaaaagcttatagagtatgtcgtgatatttctaacatgtatacattgtataatgatagagtcaggttaattaggttatcaattacctcaaacatttatcatttctttgtggtaagaccattcaaaatcttctcttctacatattttgaaatgtacaatataatatttgaactataatcaccctactatgtaatacaataccaggtcttattattcctatctatcgtaatttttcacccttgaccaattctggtgaccacttatgctactttctatttcattggaaccagatttttaagttttgcagctgtgtgagattatgtggtgtttgtctctctgtgctgccttatttcacttaggttaatgtcctctgagtttatccaggttgctgcaaatgacaagattttattcctttttgtggctgaacagtgtttcattgtgtgtgtatatacatatacatatgtatgtgtgtgtatatatatatatatttctatgcattcattcattgatggacaattaggttgctccatagcttggctattgtgaatgtgctgcaataaacatggaagtccagatatctctttgacataatgatttcatctcttttggataaacacacagtaataggatttcaggatccatatggtagttctacttttaattttttgaaaatcaccatactgtttctcataatggaagtaataatttacattcctaccaatagtatatgagttattatatctccacgttcataccagcacttgttatttttttgtcttttttaatctgaataatatacattcggatagatgtgaagggatatttggttgtggttttgaaatttatctccctgatgattagcgactgatatggtttgggtctttgtccccacctaaatctcatcttgaattgtgataatccccacatgtcaagggcaggacaaagtggagatgattgaattatggggatggttaccccactctccccatgctgttttcgtgatagtgagtgaattccaacaagatctgatggttttacaaggggattccacctttgctcagcaccgcactcttctgctgccttgtgaagaaggaccgatttgattccccttccaccattattgtaagtttcctgaggcctcgcccggcaggtggaactgcaagtcaattataaccctctttcccttgtaaattacccagtcttaggtatagcagcatgagaatcaactaatacagtgatgctaagcattttttcataaacttgctgctcatttgcatgtctgcttttgagaaatgtctatttattttgcctattttaaaatcagagtgtttgtttgcaattgatttgtttgaattcctatatattctagatattaacctcctgtaagatgcataatttgcaaatattttctcccattttataggttgtcattaactctgttgatgttttctttgttgtgtacaagctgtttagttttatataatcttatttctttagttttgctttctttgcctgtgcttttgagttattatacaaatattcttggccagacaaattatgtgaagcacttttcacatgttttcttccaatagttttatagtttttgcatcttatatttaagtatttaattcattttgagttgacttaagtatatcttgagagataggggcttgtttcattcttctgcatgagaatatccagttttcatagcaccatttattgaagagactgtttttactccaatgtgtatttttgttgcctttttcaaaaatcaattggttgtatgagtatggattgatttctgggttccccattctgttccattggtctatgtgactattttgctgatgccatgctgttttggttactatggctttgtaatatgttttgaagtcagatagtgtgacaccacaagttttgttctttttgctcaatatagctttggttatctggggtcttctgtggttccacagaaactttagaattttttttctatttctgcaaaaaatgtcattggtatattgatagggatttaactgaatctgtagttggctttgactagtgtggagattttaacaatattccttcttccaaatcatgaagaaatcatatcttctcacttatttatatagtcttcattttctttcatcaatactcagctttcattgtatatatcatttactaccttggttaaatttattcacaggtaattttttgtagtaattgtaaatgaaattgctttcttgattttttttttaaatttttttttattatactttaagttttagggtacatgtgcacattgtgcaggttagttacatatgtatacatgtgccatgctggtgcgctgcacccactaactcgtcatctagcattaggtatatctcccaatgctatccctcccccctctccccaccccaccacagtccccagagtgtgatgttccccttcctgtgtccatgtgttctcattgttcaattcccacctatgagtgagaatatgcggtgttcggttttttgttcttgcagtagttcactgagaatgatgatttccaatttcatccatgtccctacaaaggacatgaactcatcaatttttatggctgcatagtattccatggtgtacatgtgccacattttcttaatccagtctatcattgttggacatttgggttggttccaagtctttgctattgtgaataatgccacagtaaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctgtttctacacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagaagagtagattgcaaaaattttctcccattctgtaggttgcctgttcactctgatggtagtttcttttgctgtgcagaagctctttagtttaattagatcccacttgtcaattttgtcttttgttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacctatggctagccagttttcccagcaccatttattaaacagggaatcctttccccattgcttgtttttctcaggtttgtcaaagatcagatacttgtagatatgcagcattatttctgagggctctgttctgttccattgatctaaatctctgttttggtaccagtaccatgctgttttggttactgtagccttgtagtacagtttgaagtcaggtagtgtgaggcctccagctttgttcttttggcttaggattgccttgcgatgcgggctcttttttggttccatatgaactttaaagtagttttttccaattctgtgaagaaagtaattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctccttgaagcaattgtgaatgggagttccctcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggacagaacttccaacactatgttgaataggagtggtgagagagggcatccctgtcttgtgccagtttttaaagggaatgcttccagtttttgcccattcagtatgatattggctgtgggtttgtcatagatagctcttattattttgaaatacgtcccatcaatacctaatttattgagagtttttaccatgaagggttgttgaattttgtcaaaggctttttctgcatctattgagataatcatgtggtttttgtctttggctctatttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgccccgctttggtatcaggatgatgctggcctcataaaatgagttagggaggattccctctttttctattgattggaatagtttcagaaagaatgataccagttcctccttgtacctctgatagaattcggctgtgaatccatctggtcctggactctttttggttggtaaactattgattattgccacaatttcagatcctgttattggtctattcagagattcaacttcttcctggtttagtcttgggagagtgtatgtgtcgaggaatttatccatttcttctagattttctagtttatttgtgtagaggtgtttgcagtattctctgatgatagtttgtatttctgtgggatcggtggtgatatcccctttatcattttttattgtgtctatttgattcttctctcttttcttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatgtagtgctataaatttccctctacacactgctttgaatgtgtccagagattctggtgtgtggtgtctttgttctcgttggtttcaaagaacatctttatttctgccttcatttcgatatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttcccagtatgtggttaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcatacatatttagcttagctcttcttgttgaattgatcccttgaccattatgtaatggccttgtctcttttgatctttgttggtttaaagtctgttttatcagagactaggattgcaagccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccacttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatctgctcttagtctgatgggcttccctttgagggtaacccgacctttctctctggcttcccttaacattttttccttcatttcaactttggtgaatctgacaattatgtgtcttggagttgctcttctccaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgattgtctgaagccttcttctctcagctcgttaaagtcattctccatccagctttgttccattgctggtgaggaactgtgttcctttgggggaggagaggtgctctgcgttttagagtttccagtttttctgttctgttttttccccatctttgtggttttatctacttttggtctttgatgatggtgatgtacagatgggtttttggtgtgggtgtcctttctgtttgttagttttccttctaacagacaggaccctcagctgcaggtctgttggaataccctgcagtgtgacgtgtcagtgtgccccttcttgggggtgcctcccagttaggctgctcgggggtcaggggtcagggacccacttgaggaggcagtctgcctgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttccaggctgctttgtttacctaagcaagcctgggcaatggcgggcgcccctccccagcctcgctgccgccttgcagtttgatctcagactgctgtgctagcaatcagcgagactccgtgggcgtaggaccctccgagccaggtgcgggatataatctcgtggtgcgccgttttttaagcaggtctgaaaagcgcaatatttgggtgggagtgacccgattttccaggtgtgtccgtcacccctttctttgactcggaaagggaactccctgaccccttgtgcttcccaagtgaggcaatgcctcaccctgcttcggctcgcacacagtgcgcgcacccactgacctgcgcccagtgtctggcactccctagtgagatgaacccggtacctcagatggaaatgcagaaatcacccatcttctgcgtcgctcacgctgggagctgtagaccagagctgttcctatttggccatcttggctcctcccctgctttcttgatttttttttaggtactttactattagcatagagaaatgctactgaattttgtgtgttaattttgtacactgaaatttactgaatacatttattagttttaattttttttgtggaatatttagtgttttgtatatataaaatcatgtattctaccaacagggataatttaattttctcctttccaatttggatgcactttatttctttttccttgcttaattaccctggctaggacttctagaactatgttgactgaaagtcgtttcttgttcctgaacttcaaagaaaagctttcaacttttaccctttcaggatattagctgtaggtttgccacgtagggcctgtattacatagagatagatctttactatacttaattggttgagagttttcaatcatgagagggtgttgaattttatcaaatgatttttgtgcatttattgaaacgattatgtattgctggttcttgactctgttgatgtgatgtatcatatttattgatttgcacatgtgaatcatccttgcatccctggaataaaccccaattcattatggtgaataatgactttaatgttcttttgattttcatttgctagtattctgttaagaatttttaccattacgttgatcaagggaattggcctgtacttttctttctttactgtatccttgtctggttctgatagtagggtgatgctggcctcatgaaatgaatttgaaagactttgaaacaactatatgccaaaaaaattgagaaatctagaagtggttatataaaaatggtattggttttttaaatgtttgttaaaattcagcagtgaaattatcaagtcttgggtttttctttgctgataaactttttattactgatttattcttattagttgttattattctgtttagattttctatttcttgctgactctattttggtaggttgtatatgttcaggaatgtatacatttcttctaggtttctcaatttgttggcatatagatttttataatagtttctttgtgttcctgtgctatcagttttaataccttctttttcatctctgattgcatttatttgaaaattatccatatttttagtttagttaaaagagtcaattttatctttttttggaaaaaactgttttatttgctttcctttattaacttctattttgtgtatttctgctgtgatctttattatttcttttactatagttattttggattaactttgctctggcctttctagttcttggatgtgcaatgttaggttgtttattgaagatctttctaatttttttgatgtagacatttattgctataaactttcatcatagaacttctgtgtctataaggttcatttgagttaggatacagtttaaatccattttttttgttgttgattctatgtctggatgatctgtccattactgaatgtggttgttgaacttccctactattactgaattgaagtctatctctctctttagttagcaaatattttagttatatttgcttcatatattttggtgctcttgtgctgggtgccaatatgtttacagtttttataacctcttactaaattggcccctttatcattatacaatggttacctttatctgtttttacagtttttgattgaattgtattttctctgataagtatagctatcctcctttcttttggttttaatttgcatgatatatcattttccttccctttactttcagtttatatgtactcttattgttgaagtgagtctcttgtaggcaacatatagttgagtcttgttattttaatcaactcagccactgcgtgtcttttaattgaagaatttaagccatttacattcaaggttattactgatagctaagagcttactcctgccattctgttgttttctaaatattttgtagaaaaaaatgtttttttcttcttcttctgttgtataactttgtgattaagtggtttcctgtagtagtaagatttgattcttttctctttctcatttgtgtatatattgtaattttttcctttgtgactaatctggcactttcatgaaaaattcttgtagttatgtaagtatattttaaactgataaaaattaattttgattgcatgcatataattcagacatctaccccaccataaaatttataattttattgccataatttacatttttcatatcttcttgacaacttattgtaactaggattatagcttactattttgaaatttagcttttctactagagatttgaaagattatatactatactacaaggatagtaatagtgtattatgaatttgattatgagtttctctctaaaagtaagggttatactttcatgtgatttcatagtaataactccattttgcttctagttggagcagtcttttaagcattttgttgcaaagtctggtttagtgaaaaatttcctcagccttcatttgtttagaaaagactttatttcttcatttctgaaaaataactgtgctgaatggcaggatttttttttctttcagcactttgaatgtataatcccattcttttggcctgcaagttttctgttaagaaatctgctgataatctaatgggatttcctcatattagacttgatgcttttatcttgctgctcttaggattctctttgtctttcagtttggtagtatgattataatgtgctttagaaagaacctcttttgtttgggattcttttgagtttcatggattttgatgtccatatgtttctcaaggcttgggaagttttcatctattatttttttaaataagatttctgtgccttcttccacctgttctctctttataacttccataatgcaaaaaacatgctcacagaatggtgtcccatatatcttgtaggttttctttgattattttttcttcttcttttttcttgacagaattattccaaaatatttgtcatcaagttctgaaacttctttcttctccttgatatagtctgctgttgaaagtctcagttgcacttttcatttcactcactggggcttttaactccaaatttttttaatgatatttcactctttggaatttgtcatacagaattgtatttctcatttttttcaaattttatatctgtgcttcctttatcttgctgaattaaaaaaaatgttataatgaattccttttcaggcagttaaaaatttttctgttctctggggttagttactgcaaatttattatatttatttggtgctattctgcatccctgtttttaatttttcttgtgtctctgttgatgtctgtacatctagtggaacagtcaccttttcttatattttagagtatctttcacagggaaaaattttcacttgcagatgtgtcttagggtgtcatttaggcagggtggattgcctaggttccaggtgggcacagtgttgtagtatccatgcagtttattcagctatagtcatcatgcttgtgagtgcctcaattgcctaagctgcagcagcttgtagtttcttagacacagcctccatgctgggctgattcacaggtcaaatgtgggtaggggctgtttggttatttgatcaggcatggcttgtccgttgagggtgaatgtaccaggctgttctgggcaatgaacagtagtgaacacttgtggcagagaaaggagtacttcacacatgaagagaagcctgagtggcacactgcagcatccactagtgccaaaggatcctgctgctacatgataattgtactattaggtggctctgaagaagggtggaagggaaatgttaccaaaaggcagagttgcaggcaatgcccttgttgaatatccaccttgtttggaaagggaaattgtcagtgattagaacaatatatgaacacagggtaatggtgactgacttgtttgtttggctagagttctgaaatgggagagagagaaaaattaggaggaggaggaatgggaaaatagcacatggcatggatagacatattaagtggggaagaaaacgtaaagatctttgcttattgacactttccagaaagcaatcaccaggaagaggtactaaatgatcagaatgagttgtctcgtaagtttaaactgtcataccttactgcagtactgaatgcataagtagtaattgtggcagtacacatcaaggctatgtatgggcccaacattatgggtttcccttaaccaagggatggaaaaaactgctgctgatgtccattactttagaaaatcaatcagttacttagaggcaaattgattacattgaacctgtttcacactgaaaggagcagcaattcatgttgccccaaaatctgcacaaattcagggtatggttttgtctttccttcatacaaggcttcagctaatacgtgtatctggggattcaacagaatgttcattccaggttgatagttatgtccttctaagatgcagttgacataatgacttggaggcaatgccttgtaaagattataaaaccgatataaatgactatcatgacctgtcgtgactcaaaacggtagaatgcatagatgagaaaatgaagaagtagaagtgggtttattgactatcccttccaatgatccactaatgcatttttttaaaaataaacatatgcattgagtcaatttccagaaatttatcatttttgtcatgtttataaagttttatcattgcagtttggagaaagattttgccaagctcctcgcagaaatgttgctctgcttttacatttctaaaggaaaattattttgaaactatatttttgtaaacagccaaactatcaatcaaatgtgaaggcaaaataaagattttttaaggtatttatagaagaaatgttttatccacaaactctaagcaaattacttggtgatgaattcaagaaacacaaaggattacatttagaaagaagacataaggtacaatgaatacaactgaagagagttgtggaaaaaatgatgaatcatgaatggataaacctgtggaaagcctcagaaagtaacaaatctagaccagaaatgaacgtgagaggtggtggagagaaggatctgtgcagagaatatcgtgtgacacagatttgttaaatttaaggatatgtcaaaggaaaatagcacaaaaagagaaatgtatgttcaaatttaaggatcaacaaaattaaacaagagtagtatatattatcaggtatcatttcacattacaataaaactctgatcacaataatataaaaagttattgattttcaattttgacagctcaattatatacaaaattagaaaatataactatgttagatttggggaagaagtattgcatgagagctaaaataattattaatgaaaatgataaagacacttattttataattattagaataaaataaatgtttcaggaatattacttatcaatgggaggaactaaaaataatattttaggaggaaaggaagggaagtcaaggaaaatatatgtcacttaactaaatctacatcgaaataatttgtccactgcatagtatgtaacattcaaataacaaccaaaaaaaaaacccaaaaaattacagaagcataaacaagaatatacacttaaagaactaaatgcagtattctggggagtggaactgggaatcaggtagagtgggcaaaggattggtactttttactataaggctttttgtatttgatattagagtattatgttttcaaaaatgtgtacacatgttttaataatcaacggttgtaaagcaaccaaaattaactaaatttagaagaggcatgctgtctaaaaaatatatcaatgaatgttaaaattgtgtctgagattactctagcggttaggagcacagtgtttgaaaccatgctacctatgatgagtccaggttctgccatttagtggtgtgactatgttcacatcatgttaaataagttattgcagtgagtaaaggaaaaaaaacacacaaatatgtaagatttagaaaaagaaaggatgatttaaaagcaaaccttttaaaacaaattgttattgctaaataataattttcttttcctggtcacgtgtgtgtcgttatttatcctattatcctattccttctattaagagtttttgtgtctacttttactgaaggatgttttctagtgactttttttttttgaggcggagtcttgctccgttgcccaggctggagtacagtggtgctatctccactcactacaacctctgccttccaggttcaagggattctcctgcctcagccttctgagtagcagggattataggcgcccatcagaacacccagctaaattttgtagttttagtagagatggggtttcaccatgttggccaggctgttctcgaactcctgacctcaagtgatctgcccacctcggcttcccaaagtgctgggattacaggtgtgagccaccatgctcggtggttctctagtgattttttttttttttttttttttttttttttttttttttttttttttttgagacggagtctcgctctgtcgcccaggccggactgcggactgcagtggtgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctctctagtgatttttaaagatttctttaagagctagttcataataagcctagtctttttgccacaacttgtaaacaatttgtgattgctaatacagtataagtcgtcgacaggagttttggggcttctgaattaaaattaacacactaatgatgattatctttcagttaggcctgtgaataaaatggctgttcagcaaagtagacgctgttgttaaatatactcctcttactgacaatggtgctatgatagcttttaaatgacaggaatcaacctaagagtacactgagataaaggaatggtagaataaaatgtgaagaaacaattaaaatggagcttctgttaagttattaatacactgtaagatttggaataatttcagaaatatatttaggtaatgctgtaagtggagaggattaattttctcataataatttcaattcagatagctgactttgtcagtgaaactgacaatgcttctaatattctgtgatctctgcatctcacagagacttacaataaagactaagtttaattgtaactttttttccctctgacctggacatatttttataaattcgtactgtaatcaatttcagatataagtgcaatactatgcatttaaatattctactcctttaatcctgatccattgtccttaaaataaccttggcagcttttgcttattttccttctaaatattttttccccaggagcttctttgtcccttaatataaatagacttctagtgtctgtttcatcagtgtaccagacacatccagacatactgacattctgatgtaaaaacaggttacactcatattcacatgctgcaaacaattgtgctcatgcgttctaccatagagggttatcataaaatttaaaggaatagaatatgtgaaagcattttaaaaactatgaactatatacactgtgaggaattatcatttaattaattaatttaattttgatgctttaagaaacgaatccatctttccaatactgatgtttgagtattggtaaggacagggcattacttggcttgtaagttactggccaaaactgaaagaaagattcaagatttcaaacttaaattacttgtggcaataagtgtgaaatagactgaggctctcttttcaagccatgataaatgtgcataggagagtatatttttccttctctctcctctcacagatcaggcataaaatggatacaggcatgttgataggcatctgtttaggctacaaggttgccaaaaactacgaaacaattcttgacaaaattctgtcaactgagtaatttaaggctgtccacatttcagaaattttatctgtaagaaatttgtcgacactgcatggatgatggctgtagtcactgcttccttttactgtgcagtgatttggacagtaatggacagactggtttgaagcctctacatttttggtagtataatatatggcaatcataaattgctcaaaaagggcaatataaaaccagctttcagatttcaataactgaggtcagtttgacatttagagacagtgggcttgttgatggcaagtctgcatacttttgcatgattttaaatataaagtaagtcactcagcaaacagaaaataagagtcaagcaaaaataaaattttctgcttgactgaagaggatgataagagtttatatatttattattctggagattatttaaagattagttttaattaagatgaggtgaaaggaaaattagacaaaataacattaaaaaaatttttcaacactaagaaagtataggagacctaaagccattttgtgttgcatttccagtgaattgcctcatttcaggaaaccatctttgtattatattgtcttcaaaactaggggctttaaatataagcatttatacatgccctgtctcctgcagacatccctcttgccttccttacttgctaccagataatcttatttttaaccttagaccttaagtgtgttgctagcatgatgcacaataccctgtgaatctggcttcttggtaccaattcttttgattgttctagtcttcactccctttaatgtgttcggtgccccactagattgcttgattgtcagtaaagtgccattacctctgtttggtgtcttgatccacctggaaattttatgtaagaaattgagtttaaaattttaagtaaaaagtgaaaataacataagatgaaaagaaattaatcactttgcagtatcataaaacaagaatgaaattaaaattaataaaaggagtctgcactaaactaagaaagtaacatttgatcacagttacttcctcatcatttctctccttttcacccttgctgcttagagaagataaggtctttgcagaggaagggagaaaaatagtattcattatatctgaaatatatgaaattctgttatgtgatttatcatagtatttattgttgttttttgtttttaacttttaataagccaaagtagcaatgcaaaacctagaatgagaaaagcctacctaaaccagtaagaaagaacatagtcaatgttagggagacagtaatttattcttacaaaatgagctgacctattgactggcattagaaagcagctgtagtaaactgcagttccctggtgtttgcactaaattacaagtaaaaatatttgggttccaggtctacctgttattaattagcttggggcaactcagtcgctttaggaattgacacaatatacacatttaatctgtaagtaagaggttggagtgaatgagttccaaagttttttatagctcagcaaaattgtttaattttgaggaattagttttaaaatatgactggtattaaaactaagatctttccagtttcctaatcctgttattttcaacaggtcagacattacaataatataactttcatatcttttatgcccatacagaagttgtgattagctcacagcctctgcccagctggtgttgtcaaataaaggtttattctattaggtggggcagggtgtgttggagggggcaatgaagacagaaatgaaattaaaccttcaaattatattattcttaaggcccagtctctttggagcaggtgtataaagtgggaaccaaccaatttggagattcttagaatctttatgattgtcttagaagtcccagccaggcttaaaacttagaattgtctctaatgatattttaggggagtgtacatacgctagcaggtaggcccaaacagcaatgattctggacggatttgaatttgcaactggattcccaaactctaggatactagctgtcactctctatcatttcgttatccttgtaattaaacaaccgcaaatcttctgcaaatgaattttgatttccactgccacaaggtgatagagttttactttactcatttggagagtcatctgttttggatgttgaaatgtgacctccaatgttggagaagggcctagtggaaggtgtttgggtcatggaggaagacctctcatgaatggctttgtgctatccttgcagtaatgagtgaattgtcacacttagttcacaaaacagctggttgtttaaaagagcctggaacctcctcagctttttcttgctccccctcttgccatgtgacacactggcccccctttaccttctgccatgattataaacctcctgaggccctcaccagaagcagatgctagcagcatgcttctcataccacctgcggaactgtgagccaaaataaaccgattttctttataaattacccagatttaagtattcctctataagaattcaaaaaactaacacagaggtgtacaaactatttttcaaggaacgtaagttatactttaatgttggcagtgttctcaagagcaggttagtgtgctacaacaaaggctgaattacttaacgaaagtgaaaaaaaatgcagcctagtgaaaatgtgtaatgttctgtagaactagaatgctatgtttcattgaagagttcagtataagaacctttctctgtttctgactttctttttactgctgctattctaaattttttttttttttttttttttgagatggagtcttgctctgttgcccaggctggagtgcaatggtgcagtcttggctcactgacacctctgcctcctgcgttcaagcgaaagcaattctcctgcctaagcctctcgagtggctgggattacaggcacccaccaccatacctggctaatttttgtacttttagtagagacggggtttctcaatgttggccaggctggtctcgaactcctaacctcacgtgatctgcccgcctcggcctcccaaagtgctggaattacaggggtgagccactgcacccagccctaatacttctagtcttgactcaagtatacctgcaactctccaaactcctgtgatttggggctaatataagaatcacctgtcactagttccattgaataactacattttttgtaggaagaagcgtcgaaaggctttcagagaaccatcagtcaagtcatggactggtatatggtgtaccttaaaattaccagggaagcatcttataattttgatttcctggaaagcattgcagaactactaataaagaaattgtgtgcagggcaacaaaatgtttattctatacaagttactcaccgtctatattactcataaaattgataacaactgctcataagaaaaacaaaattgtgattttaattaaacttatttctgtgttgggattgttggtgccatgatttttacccactaaacttcaattttgaaccctagaaatagtccctaccttgagttcttcaccctgtagaattttcacttttttctggtgtacagacattttaaagtttcagattaaaaaataactatcaattgtatttattttgtaagaaaagtgttaaaataaatactgtgaaatgatatttagaataaattctttgttgaaagaaaaaatatagaagtaaaatttttataaagaaatgagtacaactctgttatgttaaatggaaattaggaatagtggtaggaaatctttatagttactttagtttttagatatgtatttcataattttggatactaaaatgattaccaggaagcaacttccagtaatgatgtgcattattaccagatatatttttgtctctcaattccattctcaaatataagaaattaatattctttgggaaaaaatgttaaatttaagtctgaggcaggaaagaaacacacaaaattggaactagaacgtaaatttttgaccaaaaagcaccatatcaaagactgatgagtcataaccaaaatgatagggtggcaggtctgacgagaatcttatagggcaaatacatgatcattagagtaacaaaaataaaaacaaaaattgtttaatctcctaatgactactgcagttgattgagacacataaattatctaaaagtccaatagttcaaaataagtttaaaaaataataatttgacactatttaaaatagctagtgtaccaaatacctactttgaaaattgataaattaaagaacaggaatttttctgattcagttttctgtaaaaattctgagttttgtaaaagtaggaaaatatatcataaaattgctttttaaatacccctcaagatataattgatgcagtcaacaattatcaaacagatattaaaaccattacttgaaaacttgtttggtgactggatattcacaagacattaatgcattaccatggtaattatttgttcattataaagggaaaacaaaaaatgtgcacttgtgggttcaagctgtcacaacttgaacctggtgacccatcactaagagtggacttttagtgcttcatgatataatgtaaaatgaaatagaagcatcatactatggtcttgcaataaggctgaaaaaaaatactgaggcctttgcctctagttttcagttcacaggaaacagaataaatatttaaaaaaaaaaagattaacatatccataaggaagcaatagtatttgtagagttctgaacattatgaaggaaacctgatcttattcctctgataaggcaatgaagttggattagaaaagatttataaccggtaaatctattcttaaaaaatcttatctatcagggttggggggctaggagaggaatagcattaggagaaatacctaatgtagatcacgggttgatggatgcagcaaaccaccatggcaggtgtatacctatgtaacaaacctgcacattctgcacatgtaccccggaacttgtcttattgtttcaattaaacaaatgataaaaatactattttgttttacctgtcaatgtgaaagtgagttgagcattagataaaattaagaaactttcaaatttccattattgaaaaaaaattctttctttaaaaagctgcatactgacgatccatgatgacagttcttgattcaaatactttggtaaatcaaaaataaacaaattaaacatggtgcatgttaaacatcattcaatcttgatgatgtgggtattaagattcattaaaatagtctcttttatatatacatatattttaaacctttaggaaaatttaatttaaaagacattttaaggcatattcagtgatcttttaattactacattttggttaaatttggcctccttttgactacctaaattataaaggcaaaatgtttatctataattcagatttcatctttgctctacactgctatgggtttaaccaaccaattctaatccacagtctactttttataattcacaaaaagtaatagtacaatgaaaaatttcgtaaatttttcctgtaatttgtttgaatttctggataccactggttaagataaatcacatttgtagtagttgctattgcttaattttttttaagtctaaatttttgatttatgtcttaacatggatgcctttcattagggagataaagtaactttttacccaagcaaagtcaactcaaatataaagtagtagtgccctaaaaataattaaaataactattgctttaaaatacttatataattttaatacagatttattatattgttagaataattaaataatattcaaaaattatttttataaatataaatatttaaataatatatctatactttacaaaaaatataatattgtcattttgaatatctaaacatcaaaaagccaatagtcattctttgtatatagtcccatattgtctctcaaaagtgaactgttgatgtttatctgaataagtaatttttctagtatattgttatcagttttaattttttcacacaattaaaacacttctttaaatttgcattttgtggtcaacatatttgaaattgttgtctttctaatcaacacttctcaattgatcataatatattttttgagcaaatactccttctttaggagccaaggtaactaggaagattagatcaaatctgctaacaaataggcattatcaattttacaaatagaatgcataaatattttatctgaaatatttaaatagacactattccttagactgaattgagaatttttttaacaaaagaaaaaaaactaataaaattagtaatttcatttctcatttagtgaattttagcaaaattattatgggatgaaatcactggtcttctgttttctattaaagaatagaatataacctatctgattaaaaataagagttctgattgtcacttcaagaatggcaatgggaggagttctgcagacagacatgctccctagtgaaacagacataaattgtgaaaaataaaaataaaagaatatttgaagtctcttgaaatggtcttaagggcaaattacaaataaaaaaaaattattcaagaaaatctactaatattcactaggtgcactgagaatctgtggcatttgaactggaacctactccttttctcctatagcccctcaaccccagtataatggattttaactcttaataagtacatccagaatatgggatttcttctctcaccttacatctgaaggctatggtatattcctggtaagggtgggacatcagtattctcattcccttcctaccccagctacctgatacagaggcaattccaggagagtttggccaagaggttggaggctcccttcttccactagatctcactcataaatgaggtctttgccacagaagcgtgctgataatatttgtgcccaactgctcccacctagctcattcatagagtagagcttccattcttctttacataaagataaaggcaaataaaaatgcccagaggttgccattcctaaccagagctcttccaaagtagcagtggactcaaagaaacaggtcactattcctggcatcagttccaggtccatagctcagagactttgtctaagtggagatgcaggccatataaacagagaactctaaagctctcctgaatttgaaccagtctgtgggagaaaagaggccaaagcaggatgacagaacaggccccctccagtgattgtccctccacagaaatgtaatttgagaaactctccgtgtccccaaatatcttcacaatagctaagagaaccaggtgagagatcacagcacctgattatagcacaatgataaaagacacattgaagagggcaggaaggacagttttacattaccacacagaccctctcccaaccccagacagcacagtgcagaaagagataccatccacttgagagagaaagagcaaagtaggcatagaattttatctgaaaaatcccatattgggcccttgatagtaaaacctagcactaggcattaccccatgactcttgactccaaggtattaaccacagactgagcatctaaacccattctgacaccagacaagaatatataactcctgtgagaaaaacgttagttatagcttgcatcactactggctgactatagtggccttgggcttcaaataactcacagcaacaggctggcctcagcagccatgagttttgagtatacgccagtgctgtgcctgtcttagcagccaaaatattgttcagtccagcattgttccagttatgatggtcttgggtttagggcttccactagctagcactacaagaaatgcagtggtcagggcttagggacaacactagatgacctactcagaatctcagaatgggcttactattgaaggatgttcctcaacaaacctagagtgcaaagaatggagcaagtacctacttcttcaatgtgcaaggataaacacgtgacaaggatttagaacaatcaagaagacatgacatcatcaaatggacaaaataaggtaccagtcaccaaccttaaagatatggaaatttataaactgtgtgacaaagtattcaaagtatctgtcttaagaaagctaaaaaatctgtgagaacatataaacaattagaaaacataggtaaaacaagtgatgagaataagaaatttaagagagactaaaataataattaaaagaaatcgaatagaaatcctggagttgaaaaaataaatgaacaaagtgaaaaatgtaatagtattaacagcagaattgatcaagaggaaaaaattctataagctcaaagacaggttatttgaaaacatacagccaggggataataaaatgaaaaaatgaagaaagcttatgggatttatgagatagtattaaaggagaaaatgtatgagtgattggtgtgcaagagtgaatggagaaagataaagggatagaaaacttatttcaaagaataatagcacaaaaaaatcaaactaggaacaagatataaatatccaggtacaggaaggtcaaaggtttccaatgagatacaatccaaataagactactccaagacatattataatcgaattgtcaaagctgaaagaaaaagagtgaatcttcaaagcgacaagataaaatacgcaaataaatggagttcaaatgtgcctgtagcagacttctcagtagaaactttacatgccaggagataagatagtaggatgatttattcatggtgctgaaggaaaaaaaataaaatctatgccagtgaagaatatggtactgagcaaagctgtcctgcagaagtgaaggaaaaataaagactttccaggagaaacaaaagatggagattttcatcaccatcagaactgtcttataaaatatgctaaaggtagtacttcaagctaaaagaaaagaaggctaatgagtttagcctaatgagttagcctaaaagaaggctaatgagtttcatgttgtttttacaacacaaaaacatgtaaaaatataaaagtcactggaaaaggtaaggacacattcaaattcagaattctctaatactgtaatggtggtgtgtaaatcacttacaattttaggatgaaggttaaaagacaaatctattaaagataataataagtacaataatttgttaaacgctatgcaatattaaaaggagtaaattgtgacgtcaaaattgagggccaagtgaaaacagagttttttttttttttctatgaaagttaggttgttaagcacttaaaaaacttcatattactatgttttctgtgagcatcatggtaatcatgaagcaaaatctgtaacaaataccctaaaaaccaaaaggaagaaacaaaatatacttccagagaaatcacttaattataaaggaaaattgcaaacactctctagttacaggagccagaataaaaatggatcaatctgtgaagttatttatgtgccagatcattgttgaaaacaatagagcaatcagcatgtaattaatggagcttaatagctctatgtaattaggaaagagacaaagagaaccctgtcaaaccactgttatctcaaggtgacagtgtacacacccaaggttgtaccatcattaaaatagttctgtcagtcactaaacaaatacacaagtgaacaacagtaacaagctgtggggaagggtgaaaagagtatagagtgttgctacaatatattacggaaaatatctaaatttcaacaacaaaaaatgatgatttatgcaagagacaagaaagtagaaaccatatgaaagaaaggaaataaacaaagcaggcaatagaaactgtgagagggaccagatgttggatttagcagacaaaaaactttcaaagtagtaatcataaatattttcaaagaactaaatcacatccttaagaacataaaggaagtcatgatggcaatgtctcaataaataaacaatataaataaatatatagaaatcataataagaaccaaatagaaattctggagttgaaaagtacaactgaattgaataaacaatttactaggctcaataatgggtttgacctggcagaagacaaaaattagtcaacaaacattagaaccaaaaaaggtatatgacattttaatagagtcatggacaaggattgagtttaggtaaaatttatgccaagaaaatttttaacagacacaaagcaaagcagggctgtatataaaggagtcaatatcagttccaaataaccaagctgacacagggtctttcttcctcgggaattacaaagttaagctaaatgtggaatattacatcaggaagccacttgtttgatgttctgtatctgtgttggaaattagactgctttgctatgtcaaggtgacttaaatcttctagaagagagtaagatgttttatttactaatataatttcaaaaaaaattttatggcctattttagaatatgaaatcattcttgagtaataaaatggtaatcactcaaagaaaagagttgttgggacactttacagctgcagaatattccatggagaaatcttgtttcctgttgactctacagttggatttatctgagtctgtttgtccagcgcgaggaatgatagataacctgattttttactagaaacatctattgctactgatgataaatataatttcaacattggcattgttcttctgctaatggtgctaaaacattaaagatatcatttcacttacatttcagcacaagaatggtcaatttttatttttatgtcaatggaaagttagacttcttacagtaataggtaaactaatgttttgtagctcaatgtgtttccactgcttacaagcacagtgttctaaatatttgacctttgatgtggatattggtgcttcttcagtggatttatcctctggattttcttggtttctgtgcactataatcacaaaagccccaatgaggatttaaatgtcaatgaaaattttattcaaattatactttaatcaccacattttttagtatttaaattgcagtacctaaagtttcattttaaacttattatttcaaaaggatgtactatagaataaaaatttgtttctaaaaactaaagccaaaacaccgcagcaagaatgttcaactgttttctataagctctatgacagcctatttctgttcacttttctgagctgtgcagcctatttctgagcacatttcatgtacacctaatgtacaattccccacatttatccttgacctgacctacaagagacctaaaatattaggacattttgaacactgcaggattacctatgagagtactgccaatttttcagcaaatgcccagcacagtcagagaagcactggatgcctctccagttgtgcttctgaactcattttgcaagatgtactttgcaaggaaggagttatcaatgctgtgtctacaacggtagtaaatgacaaccatcttcactgagcatgcttgcttagaaaatagcagaagtttaggtaaaaagtgaaggcttgtggaacaaatctcagttactttcatacattttgtaataataacatttacctaaccatgatgcattgttgaaaaatggaaacctacgagatgctgaactggatggaatccaggactatggatagctataattgagactctggcaggtgaacatcttgtatggttatatttacattggtggaaaaaaaatgtaaactcactcaagatatgtaatcaaaaatgggttcttgattataaggatacagaatgatctaatatgaagagtacttaggaaattgagttgtccctccagaggaactggatctaagagatgcttttctttgcatacctgttctttctgagtctttcactgcctagtaactctctactgttcgaccttatgggggagaaaggaaaatcaatgctaaaagctaaggctataggaaaggactgccagataatgaggggctttagaatcacattagtgtgtttagaatctactcttcaggcaacgggaaaataataggatgtaggcaagaaaatataatcgtatttatatgttagaaagatgaatgtgactgaagaaaaaaattcttaagacttcccaagagaagaaattgtaaaatctacttttcaaaaatttcttgtgcctcgtcaacagttgcagccttccaggaagtgatttatttgctgatagaatgtgtcccaagtgtacaaattaagcattccttcctacccaatctcacaggcagaaaaaaagaagcatttgaattgtacttatatttctcattatgcttcaggttctcaaattggtgtgaaacaacttcctctgtgaatagtattttgtatactatgccaagggagtacaccacagggcaataaatgcagatgttttctgagtggggccttcccataaaggaagaccatattataatttggaggaaacttttttcattactttaaatataagcactgtcagaatacagaggaaatggcttaatatatataaatattaaaatttaaaggcccaaatattaagtacaggtgtataaatggtgttttgcactgtatttttatattttatcttttaaatattttcttctataatatgtatttcaatgtagtaattattaagtatttcttatcttcaaggaataataatgattatgtagggctgtgtttcaaagtctttgtaggtcagtggcaatctggctctctgagattcttctctagggcttattaaatacaaaattcataggtctcctcctcaagagtctgattcagtggatctggtaaccatttacataaatattataaagctgagttggagaaattttctattttcaaatatttgcaagttagaaatgtttcatttcagcctcttatattccattcttcctgctttagagaaatatatattcatcatgccttcactatcacttgaacctgctaagcagaaatcctcctgcctatagtttaattctgtcctatttattcctatacataatatacttcacagcactttgaatataaaaactcctatcaattttacctcctaaggaattcaattactcctcactatcttgactaccaccactcttatctaagttacactcatctctttcataatctacaggtgtagcttcctaattagtctacctccatcaggctgtgctccctccaatctattcctcataacatagatgtacccaactttttaaaatgcaaattgaatcatattgtcaccagctcacctgcctacatgcacgtgcatgcacacacacacacacacacacacacactctttacccttaaacaatttcattttccttcaataggtttttattgcacataggataaagtcagcattccttagaagactacagtctacatatactagccattactacctttccaacataacctcacatcactactttattttcattctgtgttctgaccactgcacttttttttaaaagatatctggactatggttgacagaataatgccataatgcccccaacccaagattcccacttaataatccctggaacctaggaatgcatcatattatatggtataaggatattgatgatgcagattcaatcaacattgccaataagttaattgtaatataagatgaccacgaatagtctgattgggaacaatctaatcgcatgatttcttggaagcagaagaagcaaacgaagagagttagaaaaatgcaagttttcattttaaccaaggaatatggttccctctagaagctgggaacagaacagatctcagctcattgccaacacaaaaataagggggaccttaatcttatgacaatgagctgaactacaccaataacttgaatgagcaaggtaatcaactcttccctagagcctccagaagatatcatattctgccatcaccttgatgtcagcccatgagactggtgttgtactgctaacctacagtactgtatgataattagttcagtttgttttatgcccctgagcttttgttgaattgccaccccagcaatagaaagctaattcttatacccaagatgttatccggtgatgttccctgcctagaatatgttttctctcatattcacaaaactcgtattcgttagatttcaagtttaaaaattcgatttatcttccactttttaaaaagttatctttcagttagaaaaaaaaccctcctatttctgaataatttgggcagtactatcaatgtacattcttgcacagctgtaaatatctcagtgctatttttaatagtagattgcaaacccctaggagccagatatataacttcatactttcttgcatttcttcttgtaagcagtatattttaattttgtttactttgaacactttgcaccttttatccagtaaaaaacagataaaaggagagtgttattctagaaataggtattaaaaagagcaagatccatccactctgccccaatcctcctcaccatactgacagagtcgctacattaacttctagagttctgggacaaacccgggtcacatacaacaaggaatattcactgtttgaaacttgctggatgctacctatccaaggaagaaaatatatctataattgtacacaataaacttcatattatcataacataaggtgggtacattaataaaaaaaagcatgtttagaattgggtttgactatgtctagaggatactagtaaatttcaaaaagaaattggatatagaaaggtcttaattaattacaggaaactggaaagtggcaagtggtttgactggtgagagatacttgaaggatcaaatttagacaactgtatacaaagaagtctggaaaagaaataatcatttggatgtcatgggagttgggggaaagtgtgtggattttagtgtcttgggtcaatgatcacagacagtttctaccacagaaggggaattaaatatccaggtagttgcataatgcttacacagtaagcctcagaacagagtaaacatggtggtggcagtggaggttctagatgggccccaaagtgtgtctctctcaaaattccttctctgaattccaggtgttagaggaggtgcccaaggcactgaactttctgaagaagctttgcttgctctggacctctcaaacctaatagccttctctgtaacctttctgtgtaggggacatgagccttcccaaatgtgacatatattcaacatataaaaaggcctactaagttctctagctttctcttagtgcattgaagatgcagggtacaataaactgtccttcattcagagtgggtgttctagcatggttcagaccttgaaacttgagaatctttactaatgtggtaccctgaatctttgcaggattacctcccaactactagaattcatgtaccttgccagagaatctggagtacgtgccatattctacttttcaggtgcacttatgtggagaccagatgatctcttgtgaaagagagtgggatactgagcaaaggagtggagcaaagccatgaaatgagttactgacctttccaagtgaacgttaatttgcattgtcctatctcatgagaattaaaaatggcatactgactaaatagtttaacacatgccaagtctcagaagttgtgttgagctattccagtgaaaatactacgtccagcctagctgttgtgactagggctaacaaataattaactgtggctcactgccatgcaaaatgatccatctggcttttactgggattgggatgataaattgaatagacataagatagatgtcactaatttagcctcctttaagtctttttgtgtggcattaatctcttccagtctacataggatgaaacatggtttctaatttacttacttggctagagacaagatcagttcagtagcttccaattaaccattcttttttagtatattttattccatagatctgagaaccggtatgattattctgcaaaatgctaactatactcttactgattacaaacatggggaccacaagaatgaccgaagggtgtcagggcagcttactctcactgcaatatgagtttttgtctttgcacaagttaactctaatacagtttatgatgggactgtttttctattggtatcagtgtctgctcagaacctgcatgcagtaagccttgtaacagctgtgtatttctttttctagagtagacagttattccagaaaatggtcataggtctcattgatgaaagcattagtgaatatgttatgatgtatacttgctgaggcattgctggggcttttcttaaggtgactaagcctctccttccatgtctggcatataagtctgagaactagcttaagcctgaaaatttgaaaaataaattctgattttctactattatggataacattggccttctgttcacctacttttgaggtttttcatgtatttaagtcaagtaatgtccttcttagctgtcatctagctcacccatagtgcaatatagatttattagacaacaccccagaccctgtggtctaaggtcttttgactgccatgttgaccttgctaatcatgtcactctgtctcagttaagtagttacctgtcttatgctattttggaatgttacaattgccactggctacagaatcatcccttaagaggaactctggcctgcagaagagagcaaccattatctttacaaacaacattggtgactgctctacttagtaaattaattattgctttggtaaagagtgtgtcctttggctcttcctgaataatttagtaagttggtagattctctgatattataaaatatatctattgcaacagaatcaactctctgagctttttcatggtttctcccacactctgacaaagtatttacagcatttctgccccattcatggtaagccatcatgtatccacacttcaaagatacactccgcagtgcatgagaacaagctccaagtgccttgcctggaaattcagtcataaagcacagaagagaattccctccatattcttcctggccttatatcacctaatccccattccaccatcttcaaaataaaattataagcacattctccaaggttctgtacttccttgatagaacattgtaaacttctcccttaccaaatctaaaataatactttctacgtgacatggtgatatttgacccctgtttttttctttggattcagcgagtaaaggtaggggtaactgcaagagatgaatgctcatttaacactatatttaccccattctctgtgttaatctttgtctaacccaagcctagcattttttgccttcacatcataaatgacactaatagtacacaaatacctccagagctttttgaattattgctgactacctactcttgaataacaggggtattgcattatcatatgcatcctcttccatcttgattccataacaatttaacataggtcagagtattagcaatagtgattcaattatatgggaagggtgattgcttccctaaacccaccagcattaagatcgttgttgccatttagctgtctggtgatcaattctggaattgtatcctgagtatctacttcttaggatcaattctggcaccaaatgtggtagtttaggttctcctagaaagcaaacccttagcaaaattgatgcttgctaaaaccttagcattgattagaattaagtacaggaagaagtttatttgtaattgaatctatgagacattaataggaaagaagaaataaaacaggaaaataaaggcagtcaattatatgtatgttgttagtcaagtgacctctgaggtcatctaaagcttaaccatactagatcttcaggatccagcacaatatatgcacaatgaatggaaaagctgtgatgtttatacacaagtcactgttcatcactagttgagacctatgaggtatgactgggaatggcagttaattatctggcaattcactagcctacagtacagaaagcaaacttcactcaggtggtcatagagcccaggcaaagaaatactcatattggctactaagagttgagactgtgttgaagtgaagaagtaggggtataaaagtagagcaccagtgcttctgttgcataagtctctgctcctaagtcactataagataagaaaaacttctcaactttacatcctttcttatttcacagaaataagaatatgcctttaaactttatttctgaaactttgtataaacaggcaacaaaatgagcagaaataacattgaccaattaggaaagacaaatatacacacaaacttaaaaataatatttgttactagtcttcttttaaatgtaaattctcttccacccctgatttgtatttcttggattccaatagcatcaggggtagattcatataaaattacacagacattgccctggggaaatgtggttggaactgtggccatatctagttgttttctaattctcctgttttccacttcttagatttccttacaggtgtagattcaatattttctttcaggacctgagttatggtgagttactgttatgtagtaacttctattatgcttgctacctgcatacacacaaggtctgaaccaagaaggcaggaacagagcaacgcacactgcataggacttgtctcaagaaaatcacattgtcatatctcttttgtaaccttgttaaagtcatttgtttcaagttgaaatatttagtagtagagtgtgacacccccaggaatccctccacccacacaacaatcaggccggcactgctctacttgccctacacaaatacacttgaatatttccaaaatctatgccattcctctattccaaggactttcttactcaggcttacccgtattcctattgaactagtttgccttaattatctcctttacggactcaaagttgaatggtaaaaaccacagctattctacctagaaaaatagaaaccttgtcattaccaagataaataatgtccttactaaaactactacatgtcaatatgagctacttacgtacattttatttgtaaatttaaaaatcattttctcctttgaacttttttgcaattattggagttatcttacaatatgtatgtatgtcttgattattaggtcaaaataataaagtttattagccttcctacaggattagaaatttattccattttgaccatcagctttttataatctatgctattataatgagcctaaactacttatttaaaacccaaggtttctcttagctattcagtagcaaaaggtaatgttcttcaaagagaatacatatatattctgactgaaatattgaaacatagtgcagaaaggtgctaaaggaataagttcttcatagctagctgtattttcaagatggttccctttccagaatttttttcaagatttcacaagttttcataccctatctatgtggtgcttactttctgccagaacagcttcatcaataggagcagacagaacaaagctgtgacagggaagttacactgagtctatttgttgaccacagtttatttcccaacattcatagatctcacatctatccatatcaactttttgtgcatatcaactttcattgtcagtatatcatgcctatgctatcaattttcgttgatctcacatcctactgcagtcaacatcataaacaacatttagacaaaataatttgaatatgcctgagctcgttgatattattgaggagttgccctggtctgtttccatagaatagaatgttgcatagggtgtgtagtatgaaagaaatgcaatggatttccagtatgatagaaccaaatttaaatttggcttgaacactgccaaattgtttgaacttttgaaaactgcgtaatcatttcaaacttcaaaattctactcgatagaatgggaatttgattgttgtgataattaaatataagtagttgagtagattgttttatgttaattatgcatttaatggttacagtattagctctgtattgttacttaacatattactgcaaacttagcttcctaaaacaacacacatttatttcaaaattactgtgggtcaagagtctgggcatggcttaattggatcctctatgtaggatctcagatggctgcaatcagtttattagccagtttgtgttctcatctggagactggacttaggattaatccactttgaagctcatttggtttcttggcagcaagatgaagtcttatacaacttaactgtaatgacagaaggaatatctcatcatctttgccatattctcttaactaggtgcaagtgacaagtatctcccactcttaagaggaggtagttatacaaaagtgaacactaagcaggtagaaatcacagggtcaccttagggtcttaaacagtaaataagttattacttctccaagtcctagatttcccgagcttttaaagcccttttggcaatgattttacagaactaggtcttagattcttgctgataaaatttcttttagcatatgtttcttaatgaaaaatgaatgtgtgattttttgttttccaaagggttcttataataaaaattatttccaatagcttatgaagtatgacttcaatttcttccttaggtctcaatactagaaaaaatcaaatttcccatttctgatagttaatcagatgttcctctagtcgcatatatgcttctctaatataattatatatgtatatacatataatcattaaatttaacacatcatattattcaaaagatagcctgaagaaagattatatataatatatatatgtaaattgctagtagatatattaaaaattgtataacacctttggtcatatgaatacaaatttagaactgcagtgaaatatcagtatatacctatcagaaaggttgaaattaaaaaagataagacagataataccagggcttgaaaaaaatatgaaataactaaaattttcttatattccttatgagaatgtagtcaaactacatcagaacattttaatggtattaacttaggctaattctatgacacatgctaattttatgaccaagaaatctcactcttacagagcaaagaaaaaaaatgagcatgtatgcctattaaaaaataagtgaaacaatgtattttttataattttattaataataaccccaaattgagaataaaccaaatgaacataaataggcaaatgaaatataatggaataataaatagcaattaaaaatatcaaactactgatatgaataatagctgcaaatcaaaaatttattatcctaagtcaatgacaccagacagaaaagggtaaatactaataatttaaatgaatttcaaaagaggacgaattcttgataaatagcataaaataatggtagatgtttaaatgaaattttttttttttcctgaggcaagtattaactgggaaggggcatgaggcactttctgggaacctggactttctatgtgttgatatggattgtgattacatggctgtatacgtacataaaatatattcaagctgtatacctaagagttacacagttcataaactttatagcttatgttacactgcaataaaaatgaaagcaagcatgcatatggctagaggaatgcggggatgagccttaggtgtaggaggactaggctcttacagtattttctttaaaaataacctttgttctaccttgacttttgttaccaaatcttaaactagatgaattctgaaatcttccactattctgcgtatggactagtgagtagctaaacacatgtgaaacctttttagagttctactattattactactcacaaaaagtttaaatgtggcaattttatttttattttttgagacagagtctcgctttgtcgcccaagctggagtgcagtggtgcgatcttggctcactgcaacctccgcctcccgggttcaagtgattctcttgcctcagcctcccgagtagctgggactacaggcatctgccactacacctggctaatttttttgtatttttagtagagacggggtttcaccgtgttagcccggatggtctcctcgatctcctgacctcgtgatccgcctgaaatgtggcaattttgctaattctacattttactaagttttatattttgccgatgaacaatgtaaacacaaaacttcccttactccatattattccactctcaaaattatatatatggaaagatgtatgttcttatagctggcattttgaattagaagagacaataattgttaaattcctttttttccctattttaatgccatctcctaataaaacttcctggttatattttctgctctataaaaagagtaaggacttagaaatccacaatatgattgacacttacttaccaatatattatgataaccagtacaacttactgtaccattcaatgtgtttttatagtcttcagttaattacatggtaactaagacctcgtaatatacagtcaaatgggtttggctatagatgtgtctaatcatgaactcatatttttaaatactcacttcagaggatttttttaagctaccttactgttatattcaccttatttctccattatattttctataaaaactattgatagataacatttaaagctaatactttaaaataaatgtttatgcctttgaaggtctgagaattccattaaaagctttgattttacatacattttaggcaatagtggaatttatcagatattttattcaactctttgaaattaagatatatcacaaaaatttgaaattgtgtcatccataaaaactaatcatatctcttcctttgtaaaagtatttcaatggctgtcactggtctggtggtaaaggtgaaacttactatcatgtcttagaaggatgtaccatgttcttcccttatataattgagtctctgctgccatatccagcctcaactcacactgctcctaaatcttactcctatgtttagcctttttattgttttcaatttcttaaatacaggcttttatgtcacttatggacatttggatattgtaatgatattatagtctattttagaagttttttttcaaatatggcaattatgttactatattagagtcttgaaaataatagagttggccaggcgcggtggctcacgcctgtaatccctgcactttggaaggtccaggcgggcggatcacgaggtcaggaattcaagaccagcctggtcaacatggtgaaagcccatctctactaaaactacaaaaattagctggacatggtggtgcatacctgtaaatccagctactcaggaggctgaggcagaagaattacttgaaccgggatctgggaggcggaggttgcagtgaatcagatcgcactgctgcactccagcctgggctacagagcaagactccatctcaaaataataataattattagaattatagagttacattatactattcaagaaaatggagtagaatcaaagagcattttactgtcatatccctagccatatgcctgttttcgagaaaacatttttatatttttctagcctttcacattattataaaacgtgtacaaaagaaaaaaactgcatataaatgtctttccattgatctactgatattaataaatatttcaacagtttaaaataaatctgatttctgaatataattttcccccgtatagagaaaaataagtgaagtaaaaaataaagaagcaacatagctctctcacttcctagctgtctgatcttgggcaaattaaaagctctttaagcttcaagttttccatgtataagatcagacaataaaagggttgtgaaatgaacactccgtggatgaaatttcaaattaagtaagttgattaggtttctagcttccacacatgatacagatgttactctgtcctcataagaaagattgaaggcagaatgacagacgggacccaagaaagccattcccatgatgcatgcctggggaagcagaacatcagtttctgaggaaagacacaaaagtccatgcagattgtattctatattacttatggaaaaaaataaaagtcgcatcctgtggaaaaggaggagctaatgatgttgctgtaggagagaatggaaataaataatgataaatggggcaattactcaaaaaagcataacgatgtgaaatgtccatacacctaaaagtacaggtctaaaatatatgaagcaaaactggtgaactgtaaagagaaatagacaagtttgcaaaatttatatctcagtttttcatagaattgatagataaagtacaggacatattagtaagtacaaagaagtaaacagcactgtcaaccaacgtgatttacccaacatcctgaaatgctctgtagaaaagagattatatattattttccagtgcccatgtgttattcacccaggtggatcatattcccggtgacacagaaaaacaagctcaaaatactgaaatctgataaaactgtattattgggacataattaaatagcattcagtaacagaaagatatttgaaaaaaaacaaaccaactatttagaaattaagaacatacatctaaataaccagtggatcaaagagaaagtcaaaagagattctgtaaaatatatgccaatgaaaaaatttttttaccaatatttgtacgatgaagctaaaataatgcttaaagaaaatgtataaaattcagtgtctttgttagaagatacagatgtccaaaaatcatctgtgataagagaagggcaaattacatgtaaagctaacatcagtaaataaaatatacattaaaaacttgaaaaaaatgaaaatatagataaaaaattgaaaagaaaaccagaagtgaaaaatcaatctgtaatgaagatagttatttgaaaatatcaataaaatttatagacttctagttagactgacaaaaaatacaaaaagaaaaaaagagaaaagaaaaggctattaaaggaatattaaaaggctattaaataaatactttaacaaaactctctgtcgttaaatttgaccaattagattaattggaaacattttttaagtaaataaactaccaaaaattttccaagaagaaatagagtgagtaactttatatctgttaaaaaaattgcatttgttgttaaaaaatatagccaaagaaatctcaatattcatggagcttcttgcataattatactaaatacttagtgaagaagttatatcaatcctacacaatcagttctccaataaagaatgaagggaccaccttcaaaatcactcacttttatgacagcataattaatacacctctgaaactcaatatggatattacattaaaagaaaactatagataattatttctcatgaacatagatgcaaccaactttaacaaattattggtaaatcaaatccagggacatatgaaattgataatatatcttgaccaattttgttttatctggttattaaacattgattcaaaattggaaaatcatccaatgtaactcaccatatcagcacactaaaggaaaaaaaaagataatcttaatagatgtagtaaaagcacttgacaaaatctaacatccaattatgatatagaactttcagaaaaccaaaaacagaggaacatgttttcagtctgagaaagtatatcttagacaaacaaatcaaaaactgtagctcacacacagttctacataatgtttctacatattgctgaaaaactgggttttctctctctaagtttggaaaaaaccaaggatatcaactatcacaattcctgcatagtatcatacaggaggtcctaacaaatgcaataaagccagtaaagaaataaaagacatacagactggaaaggcaaaatatataattatatctatttgcaaacatcaaaatcgtttggatagaaattagtgaagaaccaacaaaatgctaacaaaactaataaatgagttaaacaagttttcagaattcaaggttaatatgaaatgttaacatttttattctactaatgaacaattagaaactgatcctagaaaaaagtactatttacagtcgtagtattaatcatgaaatgcttaagtttaaatctcctaaaatacatgtaatatatgtatcctgaaaatgataaaactataaaacattgattaaatataggaattaagtcgatgaacaaatatagtgtatttatagcttgtgattctatattattaagatcttagttgtgttcatatggacctataaatttaagcaatcccaataaaaattccaaagaacatttgaaggaattgacaatatttacatgaaaagtcaatgaagccagtagagacaaaacagttttgaaaagtaagaacaaagctagacgactcttgatagttgacttcaaatctgtagtaatcaagacagtattttattgaataaaaaagaggcatataaaacaatgctaaataatagaatgtcctaaaatacatacgtgtggtaattcgatttcttttcgaaagccaaagacaattaaatagaaaaggggtatctctttgataatttatgctagagatagtagatatccttatgtgtagtggttatcaaatatatatctagtaatccttttatacttcctcctccctccttcaaatgggaggctaactcatctatccttgaatgttgtctgcacttagtaattcactttcatcaagtcaaatgctgtggaaatgaaggtatgtgtcatctgttactacattatactaggcattgctgctttctcatcgatctgtctcttggatcatttggtctgggagattcccttaacatgttgtgaggacactaaaacagccttacgaagatttccatgtggcagaattgagaccacattgcaacatcaatgtgggtgcttagaaatggacccctctcctctcaggcatttcatgaatgtagcctgggaacatcttgattacaacctcatgagaaacctgagctagagctaccctgctatcaagttccaaattcctaacccacagaaattgtgaaataatgtatgtttgctcttctaagctacctagttttgggggtagccttttacgcagcaagtgataactaaattcagtatgcaaaacaaacaaaaacaaacatggtttacaactctccaataaagttaaatactgtataaacttaaccatttgatcctgcagttccttctccaggtatttgcttaaataaagcaaaagctgttgttcatacaaaacctgtaagcaaatgtttatagtggctttattcataatcgcaaaaaactggaaagagctgaaatgtccctcaactggagaagggataaatgtagtattataatcttagcagtaaaaaggaatgaactatagacaaatgaaacaatgactgagttccaagtacatcatgctaagtaaaataagacagactcaaaacactacatattatattatttcactcacatgtcatcataggatatgcaaaaatgtttagttttgtaacctatacattatctataaattaaaaatgaaatcaaaatcaaatgattaactaatgtcctaatcatcacagacatttgataaagatgaaattttactatcactaactaaaaaatagttatattaacagatcaactttagtttcgtcaatccattttcataatatttcacgaagtagacaaatctctaaaaagtgtttttgcaaataatccagaaattgcctttttatttatctttctcttccaatttttagcatttcaaagacttccttttgcatctgggagaaaaactgtggctcatcaaagaattagggtcacatcagatacatgttggcttaggatatttttaatcctactttaggtttttttctaactgttagtcattaatttacagtacaaataaaaattagtcatttatgaggttcaaagcaatgaataaagcagtgaaagtgccagtgcttgtgagtttgttaatgtttatacttgacacttcatttatttttttctgggcattcatttaaagtcattttaattattacctgtttagaataagatgcaaaaatatcttcacatagcctatagaataaaggaagaagtagaaaaataaaccatatcatattatgttttgtattacagtacactatagtatggtgtactataatatattataccatactgtaatagaatagaatatattagattagaatacaatcaaatatagtatactgtggtatattatattacactatattacattataccacagtacctcagggtatactatattacattctattctaatatatatatataacatagtatagtatactatattatactatattagattatattttatcataaaataatacattatattattaataatatactatatatagcatatattacaccattctatataataaaatactatattatgtatatagtatactatataacactatagtatactatattataaacaaaattatgatagtgtatggatgtctttttatggaaatatgcaaaagaatatgagagcactatgtagatagatgccacgatgcattcagttacagaaataaatctgtttttattactttcagttgtttgcttctttataataatttcaataaatggtttatacactttctaatgtaattgcagatttaattgattaaaataggctaagactttgtcactgaaaataatgtcaaaatcacattagcatcactagagctagttaaatcaagttattgtaaaatataaacatgcttgatagatctaagttccattaccaacttaattagctagaatttcattctgtagtagaaatgtctttaactttccatccgatagtaaataattctacgtgcattcaatagaagaaatttcacgagaagtgattgtagttttgatgctggtgaatgattagaaatttattttgttatgatgtaatgtatggaattaaaaggataatgagattatagtcaaccattgaaaatgtcttgggaaaaaggccagtaggtatgccacagagatgccacatgtgacagccaggaagtacaatgatagcacatttctgttggtgaagaaaggtaacagcttagcgtgtgaatgcgtatttatcacttaatgaaactctctcacctatttctatgaaaatcaatcttggaagggaggttaaggaaaatagaactataaagagaaggttttggagatgtttagccaaatactcttatctgatgaactggctgggctacagaaaacttgattccatgtacagaaaataaagctttagtctaaaaaaaaaactttaatatttcttgatgactgtctatagacatagcatttatgtctagatatacattatgaaaattctcttgtcatcagaattaataattgtgttccattatgggctgaattgtgtcaccgcaacatttatatagggaagtccttactccatagtacctcagaatgtgactgtatttggaaatagggtctttcaagagataattaagttaaattgtggttctacgcaagagcactaatccaatatgacgggtgtccttttagtgggagattaagacacaagacaacacacaaactgaggggaaaccatatgtgaacacaggaaagaagacagccatcttcaaggcaaaaaagagtcctcaggagaaactgtatcagcagacaccttgatcatggacttctgggcttcaaaattgtgagaaataattttttgttgtttaaaccacctaatatgttgtcttttgttatggtagcccaagaaaactaagacatattctcattcctccttccttccagatgcctgtgccagtttctacctcatccccacaaacaaagttataaagcaagaccagataagattttttagaataaaaaattcactgcttcccttctctgcctgaaaacgtcaaggttattgaataaataaaaattatctagcatgatatatacaacgtttcagaaattaattcaaatctctttttctaagcctttatatgctgcttaccattcccaaaatatgtcttgctcttaattttttctgcttccccacctttgcagatgttaagcaatcccttagaatgttcttttcttcctttcctagctcacaatttttaatccagttccaagtcctcttacaaacatctcgtttttcaaaattatttgactatctccagtcagaaatatatttctctatatatttcgcagaattgtgtacctattcattcattctccaatatttgttgaatactaattgaatgccaggcaggctactaggaaaggggaaaaaacattaaaccacttggagtttcatgaaccttacattctattgaaagataggtattaaatgaaaatgtatacatatctctacaattaggatagcacatgtattgcctaatttatgcatcaatctttagcttatgcacaattcatttgtatctattcatatgaataaattataagtactgaataaattaatacacaaacaaggatgatattgtttataggtggactcagaggcttcctacatcccatgatgccaaaccccttatttacccaaaacgctaaacatctgcttgattataattgttaatctattacaaggaaaacacagttcataaacaatatagagaagaaaatgcaaattgcaaatataatgtagtttttgacatatccatgctaagatgtgagataccagattcttttttgaaaatctagataattgtagattcacatgcaattgcaaaaggggtgcgggaaggggagggttaaagacaagatgattaatgggcacacatatactcttaaataaatgaagttaagacctagtgttacacagatcagtagggtaactatagtttgcaataatctgttgtatatattaaaatagctaaaagagaagaattcaaatggttctagcataaagaaaaaacaaatatttaagatgatggatatctgaagtacactgatgtgatctttacaaattattggactgttttaaatttatcacatataccctgaaactgcatacatctgttaatattatacgtcaataaaatataaataaataaataatatcgacagatccttggtaaaatttacccatttttcctgacactagcattttgtaaaactacagtataatatcacaattggaatattaacatttatgcaatatatccactcagatatatccagttttacttttattcagttgtatgcatttgtgggtgcatgcaaattctatgtgcagtgttatcatccgcgtaggttctaacatgacagtcaagatacttaccagtttcaatacccaagaatcccttatgtgaactatttatctactcccctcagattcttttgagatacatgttatttattatgtattatatttttattgtttgtacatgtaggaaccacatagtatcccaagaagagaaacaattcaattagtaagaaggtaagtacagaaaggaaagaaaaggggcaggggtctcattatttattttgagtcactgtcataatctggttaaactaattctaggcacttatttttgtccagggatttcgctaagcacaagaaagtttataaagataagtaagtaacaatttaattttttccccctcaattgtgagaggtaatcagtctgaacaagataagcactgtgagatctacaatatgcaatccttggatcatgcaatggcaaggaaaaggagtggtgccatccatgttaaactatttgttgtttagcttttcatgcatacacagtacacacttgtacataaacacattttacatactattgtccactcacaaataattcacatattacagaatatctgaatgtacttttatctgaagactttctcttaattcctaggcttttcagcattttatgacttataaccatttccagctacttataatgtaatatttgataagtactactgactgcccctctttggattctcatagatttgtctctcctcttcaataacagtttccaatgtggggagaggaggatttgtgtggcaggctttttgatagcttgtttatctgagtatttttgttaagatttcataattgaatgacaatttacctagatacaagattctatgttctcagtgctttgtatacaatatgttaaaaatgtgatttcagacctttttgcctttaagttttccaaatgcaggtaaagcctgaaacttcagcagccattttgatgtcatgagggtaatcagcctaaaagggaatgccagcatgccaaggatggtgagcacaattttacatagaaactgagtctttgattatgttggtgaggtgctgaaataatcaactttgggaagaaaaaatgtgtattttattgctaactttcatgcaatgttgctggtggaaaatctgttatgcctttgtataatacataattttaaaaattagaacatcttctttctttgtaataaataattaataaaataattaaatttcttgttaattactgtattgttcagtcaaaattcattcccttctagtagattaacccaggatgagttccacagagctcaaatttggctactggggttcagtaacatctttagatatctagggttagtaagaatctctaagaaaatcagactattgatattggcaacacagcctcttctcaaaatgtctactgtcttcaatgatactacaacacccctctctttaaaagttaacttgattgtgtggcaggtcttggaaatgggaaggatgtgaacaagactccgagaagagtagtggaggagaaagagacaagccgacacaccacaacatttatgtgacataaaatctcgagttctgaaatattttgatttctgtatccccagtggacagagcatgccactacctagcacagaatacatatgtagatattgaataaataagttatccctataaatagtggaatcaactgtttcattagacagaggctcatatgatgatggtctacaagaagtgtctacatctaagttttaaaattcaacattcaatatacttagtacatttaagttatttgttgaaaatgtgcaacagttttttaaaaacattatttttcagtatagtttagtagatccatacctattcttttttggattccaagaatgagagaaatgtagcaagtttggcgttgcttttcaactgccacagtcacaaaatagcttcctattagtgaagaattttgttttctgcctttttactgtgtagaatgctttccaagtagaatataaacctaattcattcatattgtgctaagtatgtttgtatcattaaatttttgaagaaaaacatcaagccgtcagcttcatggaggtctaattagtgtgcagaactgccttgactacattcttaaaagatgtaagtaaaactataaaaacatctttcttggtgttgaggttttaaatgaattaattaagtttattccaattaggtcatttttctttcaagaaataatatcactttcaacattttctaatgtttcatatgtaaaatgagtaatctaaacttggagtctctacgtcctcagcttgcatacattctgttcttcacctgttaaaatatagacaaattctttaatgaagttcgtctctatcagttcacaaattgtctcttacttggtcagtacattaacaacttttaggcctcctacatcactattttattgcattggctgttgtaaaatatgttctcaaatttttcttttgctctaaaccccctgaatgtactgtgtaattccttggctgattttaaattgacatttaaaattacatttaaaaatgtatattttagatatttgccaagtatataatttcaaaaatgataaaaaatattctttaaggataaaaatatttatttttatataaatgaatggaatctaaaagctatagtgatttaatacctgtcatcaaaaattcatcgtatattaatgttctctttttcactactcataaatcgcatgctgttttattttcattttgttttcacatattcttttgacttctctgatagaattgatcattatataatctatttaattgtttgaaaacattgtatctatcaacctgtttagcattctgttatagaattctgtacatgtattagaatataagtttttccagggaacatacatttttaatattagaaaatctctttcgttgttattaaacatgagttatcatttatatggtaattaatacaaaatcaaataatataagcaagtgactgttttgtatgaataattattaactacaaatactaaaatattaattaaaatgtatctgttaatattattccatggagaaatattatcagctttttcaaataattaaattgtcaaataggtgaatttatgcaggaaggtgattttagttttctcttagtgatgaaaactatcaggcaaataattataattattatttttcccagtcatattcctgaaatgcttctgtcaattcaataccctttaataaaagactcagctaatatcattttaaatcctctctgttagaaacaaggaatttggaagaatattcagtatttcaagatacctaaaataatagctaccactttctgagtgcttagtatgtgtgaatcacattttttgtggaatattttatctattcttattataatcctatgaaataagatcataccaatattatgtattaaagaagtaaggatcacatattagagatgttaaataaattttcaaaaatgttacacctataatagggaatattaaatttaaaaagtagtggtattttgtactgttcattgaaatatagttaaacaatttatctcctttgattgaactcatatggtggcatttggtacaaagccaaagtgttcacatgctttgtgccctatcatttttcaaattgagataatatatgcatatatagtatttttttttttttgagacggagtcttgctttgtcacccaggctggagtacagtggaacgatctcggctcactgcaacctctgcctccccggttcaagtgattctctcaccttagcctcctgggtagctggaattacaggtgcccaccaccacgcccaggtaatttttgtatttttagtagggatggggtttcaccatgttggccaggctggtcttgaactcctgacctcaggtgatctgcccacctcggcctcccaaagtgctgggattacaggcatgagccaccgcacctggcctcatatataaattttaataaaatatagaaaagttgtagaatgttttagtgtctgtagtgatgtggatccttaatgcgaacacatgagaaaaataataaattcaaactattttcttaatacatgagatacttatgtttcattttgtatttttgtaattgttcataacttggcaaataaaactgtagtaaaatagaatgcaaatttacactgatattttgttatgatgacataaatattcccatatgcttttggatatgaaattggttatgaaacacaaatagagtatttcactgtagtcaaagctagtgaaagttacagaaaaagtaagaggaggccaggcgcggtggctcatgcctgtagtcccagcactttgggaggctgaggcgggcggatcacgaggtcaggagtttgagaccagcttgaccaacatggtgaaaccccatctctactaaaagttcaaaaattagccgggcgtggtggcgcaagcctgtagtcccagctacccgggaggctgaggcaggagaatcgcttgaccttgggaggcagagcttgcaataagcggtgatcgcaccactgcactccagcctgggcgacagagtgagactctgtctcaaaaaaaaaagaaaagtaagaggaaaggaatttgcatttaaatagggtatggctgagacataggtaggatgcaaaaatagccatttatatgtatttagtgagcttctataatttgtccagcactaagttatgttctagggctatgtctataaatgaagattgacactgaaacagatacagaagcgatcacatccttttggtgcttaaattactttgcagtgaacctctgggtttttttcctcaccaacacaatctctttccctccacccttgttttcctgacttatctaacccctccccctttttgtgaaattggctcttgtacggccatgtgttatacacaagcataagaccaagccagattatgtatctgggcagctttgatcttaaaccaagtcatataggaatacaagtcatttgaagtttaattatcagatttcagaaacttagagttagtttcttcatttctgcagttgagattctgttaaaaagagtgaggaagaccctaattgtttgaagaaagtcaatcttaaggaggaaagaatttgcttaaatatttagggaagcaagcgatggaggaatgaagagttgggaaaatggtgttgtgtatgcgtgtgtgtgtgtggtgagtgtgtttacttgagcattctgcatataaccatccatattagtgttgttcatggacttgatactgacatgaatcagtaaagtaccctttctaatttaactgccttgacttaggtgtttccggcatttacaaactaaagagttctgattaatacataaacatgtaattgattattatcatactatatgctataaagaaaaattcaagcttattattactgtataaactctacagaagaatatacaataatatattactcaaaagaaaaagcagactttttaatctctgcatatttctgtttttttctctcttcacacactactcaatagaacactctgacaaacttccagatatgtggggggttttgcttacaaactaagaaattattcagtggacaccagctgggtcttctctaattcaattcaattctgacactatctgtggagttgcaatgtgtcccacccagtacatggatgtgtttcccctatccagaggctctctgaaccccatagttcagaaatttttatggagtcttcatcatgtaggcatgattgattattaactcaattttcagctattctcccctctttgcagagtgagatgtgaggtagaaagctccaagattctaattattgcttggtctttctgctgaacagcccccagccaggagctcaccaagagccatctcattagaaggaaagatgctcatatgagtcaggaaattacaaagactttagaagctctgtgtcaggaactgaggtcagaccagatactagaagagaagactttatttcgcaattagtaagaagtatcttggaagaagcagaaaagatacatatgaggaagtcaatttattcttagacccaaattacagtaaccagtgatcaactgtgtataagagggaactaaatatttcccaaaaagcccacgtgaaaatttaaacattaaaaaagaaagagagacagaaagaaagaaagaaaaagaaagggagggagggaggaaggaagggaaagaaaaaaatttctttaacattctaagcaggccaaactgaacaaaggttcagaagcattaattaccttatttctactttacctttttatctggtaagaatagcaaatacagtgcctgtgaagtgggtaattgatatcattaataacaacgtttaggccaatagagcatcaggaacaatttttgatactgaatggattgcctagtcaggtgaaaataactacttgaaaatccaatttccagaatacttaatctataaacagcctaagctagaggagccagagaataaaattaagattccagcaataaagaaaactaagctaaaatagcaatcgtgtatctcaacactgaggcgagaggaacctgagggcaactctgctgtaatctgtcaccaagaggtagaagcccactatgagatgttgccttctctttctacttccacagcaacttcttcctctgcgtgtcctccttccttttctttcctcaaggaccctgttgccacactcaaccttgccaaacagagttggtgtggattttgttttcagactgaaaacttttggaaattattcaagcctgcaattactaggccatgagtgaaataaattatgtatgtttaatttattaaatgacaacttttccctgtcttttgttctatttttatcatttttctcctcatacatcactgtcctcagaatgaaatactttatgaaactgaaagttggctcataactagaactctatatttttgacaattcttagttgaaaaatattacttttacagatcaatgtccaatgacctagctcataagtgttttttcctaaagctgaaaagaaaaatcagtacttatatccctttggatttcttagtacaggcactgacagctgagttagtgtaaagcacgtggttataaattgcaagtaggcatttacagccatcaaaatctcactgttaataaccccattgatcaacaactaagccaccctcttatggataccaggagtaaagcaaccagactactgaccagtgaaacgacagaaaaataccatcagtaggccacattgacttgttactatgtaatctggtttaccttatataaaaaaaagagattttctcttgtctgaatatatgcatcctgtatccctgtccatggagtaactgtcaaacttctttacattgagtctaatggactaaattagaacatttgctttgtttctaaattccacatctattttttttttaccaagatatgttttcatcaacaaaattatgttctttcttatgctatgtgctgtaaataggtctatgtccccaaacacatacagatttaaatgaaaatcaatagaaccacatatttgtgcctattaaaagcacagcttgtgttgacttaaatcacttatctattgatggcaattgttgcacaagacataactgaaaggagacacctcactatcagagaaaagcaaaatatgttatctttacctgcaggaaaattacctactaagctcctcatactcaggagaccacaatttcaccataacatatatcttaatcaagacctgggagttatatcaaagatcatcaaatgtacagctcctataaaacatcttgatcacaaaagtagtagactagaaagaaattccatttcagagagtgaaaaccctactagcttctggcatggaactcacagacatcatgttgctttggtttctatactctggtgtttaataaaaatgtccccttaattcagtgaactttactaagtataaaagagatgtggggaaataagaaatgccctcaatacatcatttgtgataaagtaccattctttagttatagtttccttgtctatgaaacttaaatattgatcataacttttaggtttctcctctatggggcattccattaatacataattacactgcaaattctaaggacattttctgtaaaatgacatggctgatgctgtggtttagtgtactccattgaattattttgcctgagtattatggaaaaatttatctaaactaggtctttattgcttctcacttttaacaatgctctgttggatataatagtcagaagaaagaaattgaatcattaagaataactttaatgttgtatttttgactttgtttaaccttggagcagataatactcttttaaaaatagcaataataatgcttcacagtgagtaactacagatcatattaaataaggtactcaagtgtcttcgtccatttgtgttgacagtaaaggaatagctgaggctggataatttacaaagaaaagaagattatttggttcacaattctgcagactgtacaagaagcatggtatgaacatttgcttctggtaagagcctcaggctgcttccactcatggcagaaggggatggggatccatcatatgcagaaatgacatgatgacagagaaagcaagagcagaagggaggtgccaggatcttttaaataaactctttagggaactaataaagtgagaaatcgcccattactgtgaggacaacagcaagccattcatgagggatccacccccatgactcaaatacctcccattaggccccacctccaacattgaggatcaaatatcagcatgagttttagggggacaaagatccaaactacagcaccaagtttatgccaaagatgtgttaaaattaaacacttctcactaatttagctcaatttttacacttttgggttcacactgaataataaattgtaatcagttctatgtgagggtgaagaaattctccctttgcattgattgcctgtaataaacaagaaaacctcatgtcttttgtttggttaaacatacataatcctcaaagatgatctgtaatgtggctcagtttttgacatgaggatctaaaactttttctgcataagtgtttaaaagattacaatttgaaggtgtcttctaaatattatctcctttaaccattgttacctttgtcagtggagtgcatgtttacttggttgagaagaataaacaatagtttacctattttcatgttttctttcttttcatatagcaaaataggtatatttgtgggctgtgaaaggtctagatctgtgatgtattatttaaaagcataaattttcattcaaactgagtatgtgaggatcctggccccatccaccttttggcaacccctctgaatttcagtaatttataaaatggggcccataatagtacattctatctagggcttacttttatgattgaaggcattaatgttgataaaaaacttaatatctgacacaaaataaatttttctgatagctattatatatggcaatgcaatagaagtttgaaacaaaccatgaaagacatatatttgtgtttgtcattgattaattgaaacaataaaaaactcaatttaaaataattaaatgacaatagatatgtaaactggtcttttataaatctgttattttgtttctcttctattggacaacgtgctattctgagtgaacccaagttaataggcagaattgcatttctaatgttttttgacaaaaatgttcttgtaatttaggctttaaggaaaggaggaatttgtaatcccagcactttgggaggctgaggcgggtagatcacgaggtcaggagatggagaccatcctggctaacatggtgaaaccacgtctctactaaaaatacaaaaaattagccaggcgtggttgcgggcgcctgtagtcccagctctgccggaggctgagtcaggagaatggcctccaggagaatggcaggcgggaacctgggaggcgagacttgtagtgagccaagatgacgccactgcactccagcctgggtgacagagcgagactccagctcaagaaaaacaaaaaaaaaaaaaggaagaatttatgttcttttaaaaaaacatatttatggaatttttacctgaaaatctgatggttgtgaggtgaactgaattatctactaaactcttagagcaggccatcactgacaggcctggcagcatgacagaatgacaaaagactcggagctatgagaacatcagaaggcatggacagtgatagcctaactggaagcactgtcaacagtggcctctatgagactctctcaagcagcttgccacatagagggatgtgacaaggattagatgaagcagaggggagaataaaagagacgaaagacactgactaataactaccccaacagccacacacagtttgtgagcaatatgaatgccttgggaactgcctcaaatcactggagactctagaaagaaaactcctgcagaagggttggctgttcctaaaatcttgtttgaattcacagacctaacacatctgcctacatctttgcaaaggatatcagaaatgtgaaagaaaaattttacagtctggcagaggcaaatggcaaattctcttgctgatgctatgaattacaattttgttggctactgaattttcaggaataaagaatatttgttttgtccattgataatttaaagtcatgtcttagcaaattttttataaattccttgaactcagcaaatgatacttatgctttattaatgtgcattattaatccatattttaaaaattataaaatgtcataaaacataagccactcattcacagatgaattttaaaaaatgattttaaaataattttaaatgctctcatattattaatatttctgtgcaatttgattttactttagggttacagataccttctgaaaaaagaggtataaatttaatattcctttttagtaactacatggtatttcatagtgttgttaccttaaaggattaaattgagcatttcccaatttgtggatattttggctcttcctaatattttagtcacaatgagcattggcaaaataactattctggtgttatgtttttatgaactagaactttccgctattcctttcccggaaaaagaattgctggatcaaagaatagatgaatgttaaatattaataaattttccttcctttgaggctttttgacatttattgatttgtaggagttgtttatttactatggatattttatcttttgggattcttagttacaagacacacaagttgagtcaggctgagttttaaaaaatattatagaatactggatttctcaacagatacttgggagtgctaagcagtgagggaaaaattgctccaaatcatttcacagaattataactggtaggaaactactggaaaaaaaaaaaggtaaccttgtacatgacgtaactagctttgtagttgaagtttgaaatttggtttgggtatatccaactgaaaagcttacattccgtgctttggtcactgttacaagagatgctgaaaaacaagtgaagaacaatttccagttctgacagttcctaaaatgggagcacagcatgtagataggtgggaaagaactttccaggcaggaacaaccagcactgaatgaccttgaagagacggcatgcctagcatgtttgtgatacagcaagctggaatcggcaatggggagggtaaccagaggactaggaatggtataaagatcggtgaaaacaggacttagtagaacctggtaagtaatttgaattttttctttgtgaggtatagaaacactggatcactttgagcaaagaaatgaaactcactccattacaaaatgtttattctgactcttgtgttgaaaatagagtaaaggtgacaagacagaaggcagagaaactggcagatgagtcagaagattggtgaagcaagtgagagatacagcgtggaccagagtagcacctgtggacttggttataagttgggggactggagttatgattggaaggtagagccaatgttattcctaataaattaaatgtgtgtgtgagggaagaaatatgagttaaaaataacttcaaagtttctgctgagctaatggaaagttacagttgccatcatggggataggtggatcaggtttaggtgtaaataagtaggaagaagctaggaattcaggttctgggactttttaaaatttcgacatgtatattgaatattcaagtggaatacaaataggagttggaaagtcaggaaagtgttctgagatggagatataaatatgtgagttactggcttttcaagagtgtttagagcatggtaacgagtgaggtcatcaaaagcagtagcatgaatacacaagagatgtctaaggcctgacacctggaatactccaatgtaaagagcttggggagaagcagagaaactaacaaaggagattgagatggtgttgcaaataaaaccgaagaaaaatcaaaagccatgtgatacccagctctaggaagcacaaatggcaattttgtgcaaatcaaaaatgtgtcctttcctcatggcacagtactgccatctactggaatatgtttccaaaaactgtattaagattataatgcccccaaggtaaatgtccttcagtgcttagctgtaagcagtagagaaagtgtatcaagggggaggaagtatatcaaatgtttctgatctgtttaaggcttatgagtattgaaaaacgattaatggatttagcaacattaagtatgtgttgaccttgacaaatgccggtttgaagtcatgaaaatgaaagtttagttactgttgagttaaaaaaaaactgtacacattattattttcattttcttttaaacccacagtaactgaacttccattttcatgacttcaaaatgacatttgttacggacaccaaatctgtacaagaaatccccatgacacaagtttacctatataacaaactgcacgtgtccctgaacttaaaataaaagttaaaaaaaagaaataaccatagatagtgacaatggaccattctatcaagaaattttgttggaagaagaggcagagaaataggttagtctgtagttgacatggaagttgcttcaagggagtagggtggaaaaattggtcatgaaggagaaataaggaaaaattaagaccacaacactccgtagtagacgagagagaataagatctaaggcactaatgaaggaattgtctgtagagacagggaaatatatagttcgtgcataggaggtggtgaaaaacagaggctctagaaggagggtacatatggtaattagagtctgtagacactttcttcttttcacagtatagtaagaagcaaggtcagcaaaagcaagtgaggatgaaaaaggagatttgagagctctctggctagcatcttctcacttttattattgctatgggaactaggagaatctcaaaagtatttacatacttcttggagacacatttttcctgatgaatatttaatagcaccagcctaaacaaatattatttagtagaacatgcttgtttttagtcatcttctttcctcacagtgttatctgttctactcatgtattgatgagtgtccatttcatctgaatattacccaacaagtttgcatccttctctgaccttggacattggcatgtgttcctaaccttgtttccttctccatcaatgatacacattattatttaatttccaaactctgtcaaataaatgtgtgacaatatattcatgtgataaaaataatcactgataatttgcaatacatttgtagaagtgtgacttataccttatttgtgtgctgacatctagtgcagatctcagagtcaggccaactctccattgtcctcacaatcctacttgtcttagtctgttttctgacagactattttggattgggtaacgtatattgaaaatacatttatttctaacagttatgggggctgagcattccaaggttaagcgctgcatcttgtgagtgccttcttgctgatgagaactctgtacagacttctgagccagcacagggcatcacgtggtgagaatggcgcatatgataacatgctgtgctcaagtctatctccctcttctggtaaaaacaccagtttcattcccatgataaccaattaattaattatttaaatacacgaaactatgaatgggctaatcctttcatgagggcggagccctcttaaaggcctcatgtctcaatactgccacattagggattaagtttcaaagtgagttttggaggggagcaaccatagcacttcacttccccattttctgaccaaggccttcagactacagagtagctatttaattctatgtttttgacattgtcccatgcctgcctcacttttagtccaagaggtatagttttcatggtttcaaacaatgctaacagtcccaactgtcttttctttataagatcaatatggaaaatttgatgaaataaatgaaaaaaactgtatatatactaaacttctatgagctagttaatacagaatttcttgtgtccattgttgatggggatgacttaaatttcagttgagttcctacctaatttcaacttttattcttgaatggggatttccccattttgattactgttatattcaagaaaccaatcacaagaaatatttaaggataataatggctattttcttgcccaaagtggatattttgcatctccaagtttccaaattattgctcttaccaacttgttgcctgtaatcatattattcatattgatagtgagaatctttatctcattccctgcctttaaagataacttttattataaattttattactgtttacaggataggatgttactttaattcttagttttcaatgagcttttattaaaacgaagtattgaacttttgcttatctattacattagccatatatttttctactttagttaactactttggtgcattgaaaaaatagattttataatgcatagccatcttcacagtcctgaaataaactgataattatgtcataattttattaatataccctgggtttgggctaaccactgattcatttagtagcattaacattttcctctgcctcacttttagttcaagataaaattggcctatggtattatgtttctactttctttgttcaataatgttacaaatgttaccctaacctcataaaacatataacagaaattttagtatcatcaactggtgagagaatttttgttttctatttcctcttacacattctttccaagatatctggtttctctgcaaggctagtttagaatgttacacttcttacacaattctagctctatataggccataattacataaataacagaggatgaaaatcacttcaaaggatgaaacatagaaattgatgtagtgaagctttaggctgtccaggataatattttctaattaaaatgttgcaaatctggccaactgaattatgttcactttgaacacttataataagggcttacttttggtttgagtaaatacaaataaatcgcttaagaaaatatggcattattccccctcagggtgcattcaaactggaataaaaaattattacaagaagaagatgaagtcaccaaaagagctgagaattgttaaaataaagaatgtcaggtagaatactcataaggctgaactggtaacataattaggtacttgctaaaaacttatcaaggtacaacctgggcaataacaccttctagaatggcaaccagactatacagagtgttaaaaagaagaatcttggtaaaaatgatactagcaattaaaaatgagaaaactaaggataaacatgaagggttctggaaacaattcaggaagagatatttgaaaggcatgtgctatgataaagtttaagtgacataaaattaatagcaatatcaggaagcaaaaaaaatagcagaaatggaaagatacagagcgaaaggggacactcacttgaatcacaagattatatgtttgagttcagtacactgaaatatttcatttttcaatatgaaagacatgtaatatagtgacctctaggcactcatttcaatatgcaagagccattaaaaaggcacttcaaggtgttagcaggatctactccactataaccatagattgcaggtttgccttcactctgaaaagagtttcctttgcagttttatgtgagaaaaatacaatatcaaaatgagtatattacgatacagaatctccctattaaccaaatgcaatgacccaaatatgaccccacaagaagtgaatctggtgcatataactaatgaggagggtgaaattgttcattctgtaaaactgatggtcagtcactgaagagaagaatttgggactgcacttcaggaaaaagaaccaaaacagtaacacaattctgcttctacataattgtgcggaccctcatgaatcacttgtggagaaaacaaaacaaaacctcttctcagaattctgtccactaatttctaagggaaaaaaaaaatgtggtagatagaaaacatgatactgctagagcacagacatgcagataacaaatgacaaatctttctctaaattaagatttttaaacactcattttgctatttgaatacaggaagatgactcctgttttctcatttgatatatttaatggagagttcacagataacaattatttccttggcttaaggtcaatgtattaaggtcatggtagaactggaaaataaagagaaaaatgctgaaagttttcatctttagtgtatttattatctatttaaaaaagtattttaaagacactgtttttacaccgttataatgaattcaaactacgtctcatgatcttttggaaaactgaaataatctcaaattatttcctgagtacaaaatgtcaatgtaatgggagtttaaaatgtgatgacccaattatttcaattaaattatacaatatttattagactataagttgcaaactgctatcacataactttatgaattgcagaagatagaagaggacgaaataatacataggagcataaaattatctcatcattctctctttgatagaaacagacagtatatgctcattataatattcgatgacttagctgccataattggttctatcttttcataatactgtttatcctattataaacctaaattccatttgatcaattgttggtctcagagtgaaggaatcagtcttgcatgtattaatcgaagcttatggtatgaagtacagcccaagataaattttacaagaaatatgactataagtaaaatagattctgacacttctatacaacacattaacacatctttgtcataagcatgattctagacaatactactttagaactttagttctctgtgtttgaaggttgggagatttttttttaattttttacaagaaaatctagtcatatcaaaaatctgccataagagaaagattttaagttttaaagaagtcagaactatagttaataatactgtatcatttacttgaaatttgctaagagggtagccttaagtgtaacactatgttatacttatgtacaagtgagtcttaaaactcatgattttacttgtagtaactttgatttgctctctttacaaccaagcttcttgaaagtaattttgactcccagttttcaattcctcatttaatattattttaagtcataacacattgcttcatttaaaactctcctattcatagtcctaattgttcttgtctctaccaggcacttgacatttatccaaccattcagttattaaacaaatatttattcagtgcttaccttctgcctattgctgggatctgtcctggaaatccaacagtggatgcttctatttttctgtctacctccataaatagctctgcttccgttggtctccagcaatgctgtccaatctcaaccagttagttatacaaaattattgtaaaactcatgtgccagcattataatcttttcaccacaaaagcagagcttattgacaataagagtaaaatgtttcagttcagaggcaagaattatacaagtgaacattttgaagtaatgacaatgtgtgactataacaaaatgtagagacttgtaaaggaaactacatgatgcctagttgctgaaacaccattcatagtggagaaatcaaagtcacgccatgtgtgttttacaaatcattaacacactcagaataaatgcttgaaaatatgaatagcttagagaggaaagagcttttctgtcctactacttacctatctgataactagtgagaaaatggctacttcaacctgtatacacattcagtgtaacatttctaaaacctatactttctctaatattaccaagccatgtcagatgaaaatacatgtaatttttgtagctattgttttgtgctaactttactgaatttgttcaatcaaccaacagtattacattatttattaatgcccttgtctcagagccaattaatcataaacattcccacagtttgaactgtctaacaatggaatggattctcatgtgttttctgcacacttgctccccagtgacattccatgagaagatccagaagagactcccttcactaaggcattaagaaacatatgggtgaggggagattttccatcactgaaagtactctgtttgctcacttctgtgggccagatatgaaccataaaggaggccacaattgagaagtgctcacagatttcagtaggaatgatgtgattccagaaaatcagatacaacattatagaccttaaccaccaaacaaaatgtgggtatatctacaatcaaggctggtagagttgtacaggtcatcagagtgctttgggccaagaaaactctggcagtggctaaatgattttgacatccttagaacaaaatacagacccttttagaatattgcttaattcatataacaagaaattcttcaggtctggagccaaaagcttgactccagtcaccactgtggagatatagcctttcacccagtttctatgttaattttcttactcagagccctttgattgaatagggtgcctggaggactctgcactattgacgcaccactcacagtaaatctttccccatgccttccccgaagagacttatggccttttttatagcatatccactctgtgaagcaattcaccgtgaatagcttttcctggcacctgaggagttcacctagacatatactcatcttcatggatttcagagtctggcactactggtcacatccttctttccagaatgctttcccatttgttattgttgctgttgtttgttgttttgagacagggcctcattctgtcccccaggctggagggcagtggcactgtctccactcactgcaacctccgcctcccaggctcaaatgattctcccacctcagcctcctgagtagctgggaccacaggcttgtgccactgtgcccagctaatttttacgtttttgtaaagataagattttgccatgttgcccaggctggacttaattagagggctcaagtggtctgcctgcctcagcctcccaaagggctgggattacagacatgagccaccgtgccctatctgtttttccatctggattcatggaatagcctctcctgattctacttctatatttttagctactttgtattattggagcaaaatataggcacagaaatggtcctaaattataagagtgtaggtcaatgagtttcccaaatagaacaacctcatataatcaccacattgatcaacaaacagggcagccccacacctcagatatcatcgttttgacctcttccagttagtgaccatctaggtttgtcgttaccttgacttctaacactatgaattagttttgtctgatttttgagcttaatataaatgtatcatacagtatgcgttcttgtatgtatggcttcttttgctcagcatgataatgtttggaagattgcttcaatgttatatatcattatagtacattaattttcatacctcttttgtatgagtaaacacaaattatttatccattctacttttgatgaatatttgagttgtttcccaaatattactctatcataatgaaaactgttatgaacattattgtacaagtctttgcagaacatatacatttcggttgcttgattcgctcattaaacattatttttaccagtgttctgaaattggtcctctttggttatcacacatcacttttgttactacttatttctttaaaacttctacaaatacatctgtctactgagaacttctgaacttttaacaggtacttccaatacctaatatttaattttttttcttctttaattttcctttctatattaccttcttagattaatgtatgcatgacacatggtagagttacttaaaatatcgcctttttcttctcatttggtaatgaaatgtgtcaattctactgaattaacaacccttatacttaaccatcttctgccgctgtcttagtttctgcctttatcttatttgaaagtgtttgtaaaactaattttatgacagcaatgctgatgtctagtgatttagagtagtt
